(12) United States Patent
Giangrande et al.

(10) Patent No.: US 9,139,835 B2
(45) Date of Patent: Sep. 22, 2015

(54) NUCLEIC ACID APTAMERS

(71) Applicant: University of Iowa Research Foundation, Iowa City, IA (US)

(72) Inventors: Paloma Giangrande, Iowa City, IA (US); Francis Miller, Iowa City, IA (US); William Thiel, Iowa City, IA (US)

(73) Assignee: University of Iowa Research Foundation, Iowa City, IA (US)

( * ) Notice: Subject to any disclaimer, the term of this patent is extended or adjusted under 35 U.S.C. 154(b) by 57 days.

(21) Appl. No.: 13/964,904

(22) Filed: Aug. 12, 2013

(65) Prior Publication Data

US 2014/0056959 A1    Feb. 27, 2014

Related U.S. Application Data

(60) Provisional application No. 61/682,055, filed on Aug. 10, 2012, provisional application No. 61/792,723, filed on Mar. 15, 2013.

(51) Int. Cl.
 C12N 15/115      (2010.01)
 C12N 15/10       (2006.01)
 C12N 15/113      (2010.01)

(52) U.S. Cl.
 CPC .......... *C12N 15/115* (2013.01); *C12N 15/1048* (2013.01); *C12N 15/1137* (2013.01); *C12N 2310/14* (2013.01); *C12N 2310/16* (2013.01); *C12N 2310/3519* (2013.01); *C12N 2320/32* (2013.01); *C12Y 106/03001* (2013.01)

(58) Field of Classification Search
 USPC .......... 435/6.1, 91.1, 455, 458, 375; 514/1, 2, 514/44; 536/23.1; 424/400, 423; 506/1, 9
 See application file for complete search history.

(56) References Cited

U.S. PATENT DOCUMENTS

| | | | |
|---|---|---|---|
| 4,683,195 | A | 7/1987 | Mullis et al. |
| 4,683,202 | A | 7/1987 | Mullis |
| 4,800,159 | A | 1/1989 | Mullis et al. |
| 4,965,188 | A | 10/1990 | Mullis et al. |

FOREIGN PATENT DOCUMENTS

| | | |
|---|---|---|
| WO | WO 2007/143086 A2 | 12/2007 |
| WO | WO 2010/019446 A1 | 2/2010 |

OTHER PUBLICATIONS

Ahmad et al., "Probing the limits of aptamer affinity with a microfluidic SELEX platform", *PLoS One* 6 (11), e27051, 8 pages (2011).
Allen et al., "Isolation of high-affinity RNA ligands to HIV-1 integrase from a random pool", *Virology* 209, 327-336 (1995).
Berezhnoy et al., "Isolation and Optimization of Murine IL-10 Receptor Blocking Oligonucleotide Aptamers Using High-throughput Sequencing", Mol Ther. vol. 20 (6), 1242-1250 (2012).
Binkley et al., "RNA ligands to human nerve growth factor", *Nucleic Acids Res* 23(16), 3198-3205 (1995).
Blank et al., "Systematic evolution of a DNA aptamer binding to rat brain tumor microvessels. Selective targeting of endothelial regulatory protein pigpen", *J Biol. Chem* 276 (19), 16464-16468 (2001).
Bock et al., "Selection of single-stranded DNA molecules that bind and inhibit human thrombin", *Nature* 355, 564-566 (1992).
Bompfunewerer et al., "Variations on RNA folding and alignment: lessons from Benasque", *J Math Biol* 56, 129-144 (2008).
Cerchia et al., "Neutralizing aptamers from whole-cell SELEX inhibit the RET receptor tyrosine kinase", *PLoS Biol* 3 (4), e123, 8 pages (2005).
Cerchia et al., "Differential SELEX in human glioma cell lines", *PLoS ONE* 4 (11), e7971, 10 pages (2009).
Cerchia et al., "Targeting cancer cells with nucleic acid aptamers", *Trends Biotechnol* 28 (10), 517-525 (2010).
Charlton et al., "Highly potent irreversible inhibitors of neutrophil elastase generated by selection from a randomized DNA-valine phosphonate library", *Biochemistry* 36, 3018-3026 (1997).
Chen "Inhibition of heregulin signaling by an aptamer that preferentially binds to the oligomeric form of human epidermal growth factor receptor-3", *PNAS* 100 (16), 9226-9231 (2003).
Chen et al., "Aptamer from whole-bacterium SELEX as new therapeutic reagent against virulent *Mycobacterium tuberculosis*", *Biochem Biophys Res Commun* 357, 743-748 (2007).
Cho et al., "Quantitative selection of DNA aptamers through microfluidic selection and high-throughput sequencing", *Proc Natl Acad Sci* 107 (35), 15373-15378 (2010).
Daniels et al., "A tenascin-C aptamer identified by tumor cell SELEX: systematic evolution of ligands by exponential enrichment", *Proc Natl Acad Sci* 100 (26), 15416-15421 (2003).
Ellington et al., "In vitro selection of RNA molecules that bind specific ligands", *Nature* 346, 818-822 (1990).
Fukuda et al., "Isolation and characterization of RNA aptamers specific for the hepatitis C virus nonstructural protein 3 protease", *Eur J Biochem* 267, 3685-3694 (2000).
Giangrande et al., "Distinct roles of E2F proteins in vascular smooth muscle cell proliferation and intimal hyperplasia", Proc Natl Acad Sci U S A.104 (32), 12988-93 (2007).
Giver et al., "Selection and design of high-affinity RNA ligands for HIV-1", *Gene* 137, 19-24 (1993).
Green et al., "Inhibitory DNA ligands to platelet-derived growth factor B-chain", *Biochemistry* 35, 14413-14424 (1996).
Guo et al., "CELL-SELEX: Novel perspectives of aptamer-based therapeutics", *Int J Mol Sci* 9, 668-678 (2008).
Hernandez et al., "Degradation of nuclease-stabilized RNA oligonucleotides in Mycoplasma-contaminated cell culture media", *Nucleic Acid Ther* 22, 58-68 (2012).
Hicke et al., "Tenascin-C aptamers are generated using tumor cells and purified protein", *J Biol Chem* 276, 48644-48654 (2001).

(Continued)

*Primary Examiner* — Jane Zara
(74) *Attorney, Agent, or Firm* — Viksnins Harris & Padys PLLP

(57) ABSTRACT

The present invention relates to optimized aptamers and methods of using these aptamers.

13 Claims, 64 Drawing Sheets

(56) References Cited

OTHER PUBLICATIONS

Hofacker et al., "Fast folding and comparison of RNA secondary structures", *Monatshefte für Chemie / Chemical Monthly 125*, 167-188 (1994).
Homann et al., "Combinatorial selection of high affinity RNA ligands to live African trypanosomes", *Nucleic Acids Res 27*, 2006-2014 (1999).
Huang et al., "Mechanism of ribose 2'-group discrimination by an RNA polymerase", *Biochemistry 36*, 8231-8242 (1997).
Jellinek et al., "High-affinity RNA ligands to basic fibroblast growth factor inhibit receptor binding", *Proc Natl Acad Sci U S A 90*, 11227-11231 (1993).
Keefe et al., "Aptamers as therapeutics", *Nat Rev Drug Discov 9*, 537-550 (2010).
Khati et al., "Neutralization of infectivity of diverse R5 clinical isolates of human immunodeficiency virus type 1 by gp120-binding 2'F-RNA aptamers", *J Virol 77*, 12692-12698 (2003).
Kraus et al., "Cutting edge: novel RNA ligands able to bind CD4 antigen and inhibit CD4+ T lymphocyte function", *J Immunol 160*, 5209-5212 (1998).
Kubik et al., "Isolation and characterization of 2'-fluoro-, 2'-amino-, and 2'-fluoro-/amino-modified RNA ligands to human IFN-gamma that inhibit receptor binding", *J Immunol 159*, 259-267 (1997).
Layzer et al., "Simultaneous generation of aptamers to multiple gamma-carboxyglutamic acid proteins from a focused aptamer library using DeSELEX and convergent selection", *Oligonucleotides 17*, 1-11 (2007).
Lebruska et al., "Selection and characterization of an RNA decoy for transcription factor NF-kappa B", *Biochemistry 38*, 3168-3174 (1999).
Li et al., "Label-free aptamer-based colorimetric detection of mercury ions in aqueous media using unmodified gold nanoparticles as colorimetric probe", *Anal Bioanal Chem 393*, 2051-2057 (2009).
Liu et al., "Targeting inhibition of GluR1 Ser845 phosphorylation with an RNA aptamer that blocks AMPA receptor trafficking", *J Neurochem 108*, 147-157 (2009).
Lorenz et al., "ViennaRNA Package 2.0", *Algorithms Mol Biol 6*, 26 (2011).
Lundberg et al., "Delivery of short interfering RNA using endosomolytic cell-penetrating peptides", *FASEB J 21*, 2664-2671 (2007).
Lupold et al., "Identification and Characterization of Nuclease-stabilized RNA Molecules That Bind Human Prostate Cancer Cells via the Prostate-specific Membrane Antigen", *Cancer Research 62*, 4029-4033 (2002).
Mallikaratchy et al., "Selection of DNA ligands for protein kinase C-delta", *Chem Commun*, 3229-3231 (2006).
Martell et al., "Optimizing aptamer activity for gene therapy applications using expression cassette SELEX", *Mol Ther 6* (1), 30-34 (2002).
Mayer et al., "Controlling small guanine-nucleotide-exchange factor function through cytoplasmic RNA intramers", *Proc Natl Acad Sci U S A 98* (9), 4961-4965, (2001).
McCaskill, "The equilibrium partition function and base pair binding probabilities for RNA secondary structure", *Biopolymers 29*, 1105-1119 (1990).
McNamara et al., "Cell type—specific delivery of siRNAs with aptamer-siRNA chimeras", *Nature Biotechnology 24* (8), 1005-1015 (2006).
McNamara et al., "Multivalent 4-1BB binding aptamers costimulate CD8+ T cells and inhibit tumor growth in mice", *Journal of Clinical Investigation 118*, 376-386 (2008).
Meyer et al., "Cell-specific aptamers as emerging therapeutics", *J Nucleic Acids 2011*, 904750, 18 pages (2011).

Mi et al., "Targeted inhibition of alphavbeta3 integrin with an RNA aptamer impairs endothelial cell growth and survival", *Biochem Biophys Res Commun 338*, 956-963 (2005).
Mi et al., "RNA aptamer blockade of osteopontin inhibits growth and metastasis of MDA-MB231 breast cancer cells", *Mol Ther 17*, 153-161 (2009).
Mi et al., "In vivo selection of tumor-targeting RNA motifs", *Nat Chem Biol 6*, 22-24 (2010).
Morris et al., "High affinity ligands from in vitro selection: complex targets", *Proc Natl Acad Sci 95*, 2902-2907 (1998).
Rockey et al., "Synthesis and radiolabeling of chelator-RNA aptamer bioconjugates with copper-64 for targeted molecular imaging", *Bioorganic & Medicinal Chemistry 19*, 4080-4090 (2011).
Rockey et al., "Rational truncation of an RNA aptamer to prostate-specific membrane antigen using computational structural modeling", *Nucleic Acid Ther 21* (5), 299-314 (2011).
Ruckman et al., "2'-Fluoropyrimidine RNA-based Aptamers to the 165-Amino Acid Form of Vascular Endothelial Growth Factor (VEGF165)", *Journal of Biological Chemistry 273* (32), 20556-20567 (1998).
Rusconi et al., "RNA aptamers as reversible antagonists of coagulation factor IXa", *Nature 419*, 90-94 (2002).
Schutze et al., "A calibrated diversity assay for nucleic acid libraries using DiStRO—a Diversity Standard of Random Oligonucleotides", *Nucleic Acids Res 38* (4), e23, 5 pages (2010).
Schutze et al., "Probing the SELEX Process with Next-Generation Sequencing", *PLoS One 6* (12), e29604, 10 pages (2011).
Sefah et al., "Molecular recognition of acute myeloid leukemia using aptamers", *Leukemia 23*, 235-244 (2009).
Shamah et al., "Complex Target SELEX", *Accounts of Chemical Research 41* (1), 130-138 (2008).
Shangguan, et al. "Identification of liver cancer-specific aptamers using whole live cells", *Anal Chem 80*, 721-728 (2008).
Sousa et al., "A mutant T7 RNA polymerase as a DNA polymerase", *EMBO J 14*, 4609-4621 (1995).
Theis et al., "Discriminatory aptamer reveals serum response element transcription regulated by cytohesin-2", *Proc Natl Acad Sci 101*, 11221-11226 (2004).
Thiel KW, Giangrande PH "Therapeutic Applications of DNA and RNA Aptamers", *Oligonucleotides 19*, 209-222 (2009).
Thiel, "RNA Inhibitors of Intimal Hyperlasia", American Society of Gene & Cell Therapy 14th Annual Meeting, Abstract No. 350574, 2 pages (2011).
Thiel et al., "Nucleotide bias observed with a short SELEX RNA aptamer library", *Nucleic Acid Ther 21*, 253-263 (2011).
Thiel et al., "Delivery of chemo-sensitizing siRNAs to HER2+-breast cancer cells using RNA aptamers" *Nucl Acids Res.* vol. 40 (13), 6319-6337 (2012).
Thiel et al., "Rapid Identification of Cell-Specific, Internalizing RNA Aptamers with Bioinformatics Analyses of a Cell-Based Aptamer Selction", PLOS One, 7(9), e43836 (2012).
Thiel et al., "VSMC-Targeted Aptamer-siRNA Chimeras as Inhibitors of Intimal Hperplasia", American Heart Association, Scientific Sessions, Abstract, 1 page (2012).
Thiel et al., "Aptamer-siRNA Chimera Inhibitors of Intimal Hyperplasia", American Society of Gene & Cell Therapy 15th Annual Meeting, Abstract No. 350727, 2 pages (2012).
Tuerk et al., "Systematic evolution of ligands by exponential enrichment: RNA ligands to bacteriophage T4 DNA polymerase", *Science 249*, 505-510 (1990).
Wullner et al., "Cell-specific induction of apoptosis by rationally designed bivalent aptamer-siRNA transcripts silencing eukaryotic elongation factor 2", *Curr Cancer Drug Targets 8*, 554-565 (2008).
Zimmermann et al., "Monitoring Genomic Sequences during SELEX Using High-Throughput Sequencing: Neutral SELEX", *PLoS One 5* (2), e9169, 7 pages (2010).
Zuker et al., "Optimal computer folding of large RNA sequences using thermodynamics and auxiliary information", *Nucleic Acids Res 9*, 133-148 (1981).

| # | Reps | HTS read variable region | Length | 1 | 3 | 5 | 6 | 7 | 8 | RNA | Structure |
|---|---|---|---|---|---|---|---|---|---|---|---|
| >0001 | x | TCCTGTCTGTCTGTTCGTCCC | 20 | 674 | 33359 | 242366 | 269733 | 206010 | 165799 | GGGAGGACGAUGGGUCCUGUCUGUCUGUUCGUCCUGUCUGUCUGUUCGUCCCCAGAGACACUCGCCCGA | ((((((...))))((((......))))))..))).. |
| >0002 | x | GTCCTGTCTGTCTGTTCGTCCC | 21 | 0 | 23 | 723 | 3084 | 5903 | 19647 | GGGAGGACGAUGGGGUCCUGUCUGUCUGUUCGUCCCCAGAGACACUCGCCCGA | ((((((.....))))((((.....)))))..))). |
| >0003 | x | CCCTGTCTGTCTGTTCGTCCC | 20 | 2 | 92 | 1472 | 4455 | 6523 | 7066 | GGGAGGACGAUGGCCCUGUCUGUCUGUUCGUCCCCAGAGACACUCGCCCGA | .((((.....))))((.....))((((......))))).. |
| >0004 | x | TCCTGCTGTCTGTTGTCCC | 20 | 38 | 3007 | 8161 | 1874 | 886 | 121 | GGGAGGACGAUGGGUCCUGCUGUCUGUUGUCCCCAGAGACACUCGCCCGA | ((.((((....))))((((((.....)))))).....))). |
| >0005 | x | TCTTGCTGTCTGTTCGTCCC | 20 | 2 | 94 | 1126 | 2734 | 2664 | 5297 | GGGAGGACGAUGGGUCUUGCUGUCUGUUCGUCCCCAGAGACACUCGCCCGA | ((.((((....))))((((......))))))..))).. |
| >0006 | x | TTTGGGTTTCCCGTGCCC | 20 | 1114 | 5826 | 2663 | 231 | 78 | 9 | GGGAGGACGAUGGGUUUGGGUUUCCCGUGCCCCAGAGACACUCGCCCGA | (((....((.....)).((((......)))).....)) |
| >0007 | | TCCTGTCTGTTCCGTGCC | 20 | 6 | 184 | 1609 | 1383 | 1914 | 451 | GGGAGGACGAUGCGGUCCUGUCUGUUCCGUGCCCAGAGACACUCGCCCGA | (((((((....))))((((.....)))))..))). |
| >0008 | x | GCGTTTCCTCTGTTCGTCC | 20 | 0 | 10 | 211 | 720 | 1101 | 3030 | GGGAGGACGAUGCGGGCGUUUCCUCUGUUCGUCCCCAGAGACACUCGCCCGA | (((((....((....))(((......)))..))))))... |
| >0009 | x | CGTTTCCTCTGTCTGTCCC | 20 | 0 | 17 | 321 | 898 | 1126 | 2461 | GGGAGGACGAUGCGGGCCGUUUCCUCUGUCUGUCCCCAGAGACACUCGCCCGA | ((((((((....))(((((......)))))..)))))... |
| >0010 | | TCCTGTCTGTTCGTTTC | 20 | 2 | 152 | 1361 | 1184 | 1614 | 227 | GGGAGGACGAUGGGUCCUGUCUGUUCGUUUCAGAGACGACUCGCCCGA | (((((.......))((((((......))))))..)))) |
| >0011 | x | TCCTGTCTGTTCGTCC | 19 | 11 | 1317 | 1174 | 656 | 352 | 254 | GGGAGGACGAUGGGUCCUGUCUGUUCGUCCCAGAGACGACUCGCCCGA | ((((.(....)))((((......)))).)))) |
| >0012 | | TCCTGTCTGCTCGTCCC | 20 | 0 | 131 | 1026 | 1044 | 775 | 401 | GGGAGGACGAUGCGGAUGGGUCCUGUCUGCUCGUCCCCAGAGACACUCGCCCGA | ((((((((....)))).(((((......))))))..)))) |
| >0013 | x | TGAGTCGTTCCCTCGTCCC | 20 | 0 | 8 | 176 | 394 | 775 | 1605 | GGGAGGACGAUGCGGGCCGUGAGUCGUUCCCUCGUCCCCAGAGACACUCGCCCGA | ((((((....((((....))))....))).))))... |
| >0014 | x | GCCTTTGTTCTGACCTCCC | 20 | 0 | 4 | 60 | 214 | 508 | 1894 | GGGAGGACGAUGCGGGCCUUUCGUGACCUCCCCAGAGACACUCGCCCGA | ((.((((....(((((....))))).....)))))). |
| >0015 | x | TGCTGTCGTGTTCGTCC | 20 | 1 | 24 | 246 | 515 | 450 | 831 | GGGAGGACGAUGCGGUCGUGUCGUGUUCGUCCCCAGAGACACUCGCCCGA | (((.(((....)))((((((....))))))..))))) |
| >0016 | | TCCTGTCTGTTTGTCCC | 20 | 7 | 95 | 514 | 556 | 481 | 293 | GGGAGGACGAUGGGUCCUGUCUGUUUGUCCCCAGAGACACUCGCCCGA | ((((((.....))))((((......))))))..))).. |
| >0017 | x | TCCCGTCTGTTCGTCCC | 20 | 2 | 80 | 493 | 525 | 421 | 261 | GGGAGGACGAUGGGUCCCGUCUGUUCGUCCCCAGAGACGACUCGCCCGA | ((((((....))))((((......)))))..))).. |
| >0018 | | TCCTGTCTGTTCCTCCC | 20 | 3 | 72 | 430 | 443 | 445 | 344 | GGGAGGACGAUGCGGCCCUGUCUGUUCCUCCCCAGAGACGACUCGCCCGA | ((((((....)))((((((....))))))..))))). |
| >0019 | x | CCTGTCTGTTCGTCC | 19 | 1 | 8 | 202 | 328 | 394 | 750 | GGGAGGACGAUGCGGCCUGUCUGUUCGUCCCCAGAGACGACUCGCCCGA | (((((((....)))((((......)))))..)))) |
| >0020 | x | TCCTGTCTGTCCGTCCC | 20 | 0 | 58 | 439 | 445 | 450 | 244 | GGGAGGACGAUGGGUCCUGUCUGUCCGUCCCCAGAGACGACUCGCCCGA | (((((((.....))))((((......))))))...)))).. |
| >0021 | x | TTTGGGTTTTCCCGTGCCC | 21 | 179 | 955 | 381 | 33 | 5 | 1 | GGGAGGACGAUGGGUUUGGGUUUUCCCGUGCCCCAGAGACACUCGCCCGA | (((....(((......)))(((((......))))).....))). |
| >0022 | | GCTGTCTGTTCCGTCCC | 20 | 0 | 9 | 104 | 323 | 346 | 767 | GGGAGGACGAUGGGGCUGUCUGUUCCGUCCCCAGAGACACUCGCCCGA | ((((((.....)))((((((....))))))..)))) |
| >0023 | x | TCTGTGGGATGTGGCCC | 19 | 80 | 1334 | 114 | 7 | 9 | 0 | GGGAGGACGAUGGGUCUGUGGGAUGUGGCCCCAGAGACACUCGCCCGA | (((((.((....)).(((......))).....)))). |
| >0024 | | TCCTGTCTGTTCGCCCC | 20 | 2 | 74 | 420 | 415 | 328 | 252 | GGGAGGACGAUGCGGUCCUGUCUGUUCGCCCCCAGAGACACUCGCCCGA | ((((((.....))))((((......))))))..))).. |
| >0025 | | TCCTGTCTGTCGTCC | 19 | 1 | 51 | 414 | 396 | 408 | 188 | GGGAGGACGAUGGGUCCUGUCUGUCGUCCCAGAGACACUCGCCCGA | ((((((....))))((((......)))))..))). |
| >0026 | x | TCCTGTCTCTTCGTCCC | 20 | 3 | 54 | 367 | 347 | 463 | 167 | GGGAGGACGAUGGGUCCUGUCUCUUCGUCCCCAGAGACGACUCGCCCGA | ((((((....))))((((......)))))..))). |
| >0027 | x | TCTCAGTAGTGGGCCTGCTG | 20 | 11 | 266 | 716 | 291 | 84 | 8 | GGGAGGACGAUGCCUGCUGCUGUAGUGGGCCUGCUGACUCGCCCGA | ((((((....)).((((...))))(.(....)..))))))). |
| >0028 | x | TCCGCCTGTTCGTCCC | 20 | 0 | 76 | 348 | 354 | 323 | 213 | GGGAGGACGAUGGGUCCGCCUGUUCGUCCCCAGAGACACUCGCCCGA | ((((((....))))((((......)))))..))). |
| >0029 | x | TCTGTTGTGCTTGATATGCC | 21 | 339 | 772 | 51 | 2 | 8 | 0 | GGGAGGACGAUGCGGUCUGUUGUGCUUGAUAUGCCCCAGAGACACUCGCCCGA | (..(....))((((......))))(....)..))). |
| >0030 | | TCCTGTCTGTTTTCGTCCC | 20 | 0 | 93 | 336 | 324 | 257 | 145 | GGGAGGACGAUGGGUCCUGUCUGUUUUCGUCCCCAGAGACGACUCGCCCGA | ((((((....))))((((......))))))..))). |
| >0031 | | TCCGCGTCTGTTCGTCCC | 20 | 1 | 42 | 294 | 328 | 289 | 189 | GGGAGGACGAUGCGGUCCGCGUCUGUUCGUCCCCAGAGACACUCGCCCGA | ((((((....))))((((......)))))..))). |
| >0032 | | TCCTGTCTGTTCGTCTC | 20 | 1 | 52 | 305 | 359 | 198 | 200 | GGGAGGACGAUGCGGUCCUGUCUGUUCGUCUCCAGAGACACUCGCCCGA | ((((((....))))((((......)))))..))). |
| >0033 | | TCCTGTCTGTCGTACC | 20 | 0 | 42 | 265 | 362 | 224 | 188 | GGGAGGACGAUGGGUCCUGUCUGUCGUACCCCAGAGACACUCGCCCGA | ((((((....))))((((......)))))..))). |
| >0034 | | TCCTGTCTGTTCATCCC | 20 | 0 | 46 | 291 | 301 | 220 | 185 | GGGAGGACGAUGCGGUCCUGUCUGUUCAUCCCCAGAGACGACUCGCCCGA | ((((((....))))((((......)))))..))). |
| >0035 | x | TCCTGTCCGTTCGTCCC | 20 | 1 | 40 | 247 | 291 | 231 | 168 | GGGAGGACGAUGCGGUCCUGUCCGUUCGUCCCCAGAGACGACUCGCCCGA | ((((((....))))((((......)))))..))). |
| >0036 | x | GCCTTCTGTCGTTGTCC | 20 | 0 | 14 | 172 | 275 | 193 | 303 | GGGAGGACGAUGCGGGCCUUCUGUCGUUGUCCCAGAGACGACUCGCCCGA | ((.((((....))))((((......))))))..))). |
| >0037 | | TCCGTTGTCTGTCTCCC | 20 | 0 | 51 | 245 | 230 | 248 | 140 | GGGAGGACGAUGCGGUCCGUUGUCUGUCUCCCAGAGACGACUCGCCCGA | ((((((....))))((((......))))))..))). |
| >0038 | | TCCTGTCTGTTCTTCCC | 20 | 2 | 76 | 254 | 236 | 181 | 139 | GGGAGGACGAUGCGGUCCUGUCUGUUCUUCCCCAGAGACACUCGCCCGA | ((((((....))))((((......)))))..))). |
| >0039 | | TCCTGTCTATTCGTCCC | 20 | 1 | 57 | 185 | 252 | 216 | 131 | GGGAGGACGAUGCGGUCCUGUCUAUUCGUCCCCAGAGACGACUCGCCCGA | ((((((....))))((((......)))))..))). |
| >0040 | | TCCTGTCTGTTGTCCC | 19 | 3 | 46 | 204 | 214 | 219 | 132 | GGGAGGACGAUGGGUCCUGUCUGUUGUCCCAGAGACGACUCGCCCGA | ((((((....))))((((......)))))..))). |
| >0041 | x | TGACTGTCTGTTTCGTCCC | 20 | 0 | 0 | 39 | 97 | 177 | 492 | GGGAGGACGAUGCGGUGACUGUCUGUUUCGUCCCCAGAGACGACUCGCCCGA | ((((((....)))(((((......))))))..))). |
| >0042 | | TCCTGTCTGTTTCGTCCT | 20 | 0 | 24 | 193 | 222 | 195 | 139 | GGGAGGACGAUGCGGUCCUGUCUGUUUCGUCCUCAGAGACACUCGCCCGA | ((((((.....))))((((.....))))).))). |
| >0043 | | TCCTGTCTGTTGTTCGTCCC | 20 | 3 | 38 | 197 | 192 | 200 | 104 | GGGAGGACGAUGCGGUCCUGUCUGUUGUUCGUCCCCAGAGACACUCGCCCGA | ((((((....)))(((((......)))))..))))). |
| >0044 | | TCCTGTCGTTGTCGTCC | 20 | 2 | 30 | 157 | 211 | 141 | 113 | GGGAGGACGAUGCGGUCCUGUCGUUGUCGUCCCAGAGACGACUCGCCCGA | ((((((....))))((((......)))))..))). |
| >0045 | | TCCTCATCGTCTGTCCC | 20 | 0 | 30 | 150 | 179 | 160 | 118 | GGGAGGACGAUGCGGUCCUCAUCGUCUGUCCCCAGAGACACUCGCCCGA | ((((((....))))((((......)))))..))). |
| >0046 | | TCCTGTCGTCTGTTAGTCC | 20 | 0 | 26 | 149 | 211 | 133 | 103 | GGGAGGACGAUGCGGUCCUGUCGUCUGUUAGUCCCAGAGACGACUCGCCCGA | ((((((....))))((((......)))))..))). |
| >0047 | | TCCTATCGTCTATTCGTCCC | 20 | 4 | 31 | 158 | 183 | 127 | 110 | GGGAGGACGAUGGGUCCUAUCGUCUGUCUGUUAUCGUCCCAGAGACGACUCGCCCGA | ((((((....))))((((......)))))..))). |
| >0048 | | TCCTGTCGTCTGTCCC | 20 | 1 | 26 | 188 | 151 | 198 | 45 | GGGAGGACGAUGCGGUCCUGUCGUCUGUCCCCAGAGACGACUCGCCCGA | ((((((....))))((((......)))))..))). |
| >0049 | | TCCTGTCGTCTGTTC | 19 | 0 | 28 | 185 | 140 | 198 | 34 | GGGAGGACGAUGCGGUCCUGUCGUCUGUUCCCAGAGACGACUCGCCCGA | ((((((....))))((((......)))))..))). |

| ID | Sequence | | | | | | RNA sequence | Structure |
|---|---|---|---|---|---|---|---|---|
| >1005 | TCCTGTCGTTTGTTCGTACC | 20 | 0 | 0 | 1 | 4 | 1 | GGGAGGACGAUGCGGUCCUGUCGUUUGUUCGUACCCAGACUCGCCCGA | ((((((...))))))((((....))))... |
| >1006 | TCCTTCGTTTGTTCGTCCC | 20 | 0 | 0 | 2 | 2 | 1 | GGGAGGACGAUGCGGUCCUUCGUUUGUUCGUCCCCAGACUCGCCCGA | (((((....))))).((...((((....))))))... |
| >1007 | TGATTCTTCTGTGTCTCCC | 20 | 0 | 0 | 4 | 1 | 2 | GGGAGGACGAUGCGGUCGAUUCUUCUGUGUCUCCCCAGACUCGCCCGA | ...(((.((...)))))((((((....))))))... |
| >1008 | TCGTCGTCGTTCGTCCC | 18 | 0 | 0 | 1 | 2 | 2 | GGGAGGACGAUGCGGUCGUCGUCGUUCGUCCCCAGACGACGCCCGA | ((.((....))))(((((....))))).... |
| >1009 | TGTTGTCGTCTAGCCTCC | 20 | 0 | 0 | 2 | 1 | 1 | GGGAGGACGAUGCGGUCGUUGUCGUCUAGCCUCCCAGACGACUCGCCCGA | ((.((....)))).((((....))))... |
| >1011 | TCTTATCGTCGTTCGTCC | 20 | 0 | 0 | 2 | 0 | 1 | GGGAGGACGAUGCGGUCUUAUCGUCGUUCGUCCCAGACGACUCGCCCGA | ((..((....))))((((....))))... |
| >1012 | TCTTGGCTTCGTCGTTCC | 20 | 0 | 0 | 6 | 1 | 1 | GGGAGGACGAUGCGGUCUUGGCUUCGUCGUUCCCAGACGACUCGCCCGA | ((..((....))))((((....))))... |
| >1013 | TCTGTCGTCGATCGTCCC | 20 | 0 | 0 | 1 | 1 | 1 | GGGAGGACGAUGCGGUCUGUCGUCGAUCGUCCCAGACGACUCGCCCGA | ((..((....))))((((....))))... |
| >1014 | TCTGTCGTCGTTCGTCAC | 20 | 0 | 0 | 1 | 1 | 2 | GGGAGGACGAUGCGGUCUGUCGUCGUUCGUCACCAGACGACUCGCCCGA | ((..((....))))((((....))))... |
| >1015 | TCTTTCGTCGTTCGTCC | 20 | 0 | 0 | 0 | 1 | 0 | GGGAGGACGAUGCGGUCUUUCGUCGUUCGUCCCAGACGACUCGCCCGA | ((..((....))))((((....))))... |
| >1016 | TGAAGTTCGTCGTCGTCC | 20 | 0 | 0 | 2 | 2 | 2 | GGGAGGACGAUGCGGUGAAGUUCGUCGUCGUCCCAGACGACUCGCCCGA | ((..((....))))((((....))))... |
| >1017 | TGAGTCCTCGTTCGTCCC | 20 | 0 | 0 | 0 | 1 | 2 | GGGAGGACGAUGCCAUGCGGUGAGUCCUCGUUCGUCCCCAGACUCGCCCGA | ((..((....)))).((((....)))) |
| >1018 | TGAGTCGTCCCTTCGTCC | 20 | 0 | 0 | 1 | 0 | 3 | GGGAGGACGAUGCGGUGAGUCGUCCCUUCGUCCCAGACGACUCGCCCGA | ((..((....))))((((....))))... |
| >1019 | TGAGTCGTTCCCTTCGTCC | 19 | 0 | 0 | 0 | 2 | 1 | GGGAGGACGAUGCGGUGAGUCGUUCCCUUCGUCCCAGACUCGCCCGA | (((.((....)))).((((....))))... |
| >1020 | TGAGTCGTTCCCTTCGTCC | 20 | 0 | 0 | 0 | 0 | 5 | GGGAGGACGAUGCGGUGAGUCGUUCCCUUCGUCCCCAGACUCGCCCGA | (((.((....)))).((((....))))... |
| >1021 | TGAGTCGTTCCCTTCGTTC | 20 | 0 | 0 | 1 | 0 | 3 | GGGAGGACGAUGCGGUGAGUCGUUCCCUUCGUUCCAGACUCGCCCGA | (((.((....)))).((((....))))... |
| >1022 | TGATGTCGTCTTTGCGTCC | 20 | 0 | 0 | 1 | 0 | 2 | GGGAGGACGAUGCGGUGAUGUCGUCUUUGCGUCCCAGACGACUCGCCCGA | ((..((....))))((((....))))... |
| >1023 | TGCTGTCGTGTTCGTCC | 19 | 0 | 0 | 1 | 3 | 3 | GGGAGGACGAUGCGGUGCUGUCGUGUUCGUCCCAGACGACUCGCCCGA | ((((((....))))))((((....))))... |
| >1024 | TGCTGTCGTGTTCGTTCC | 20 | 0 | 0 | 1 | 3 | 0 | GGGAGGACGAUGCGGUGCUGUCGUGUUCGUUCCCAGACGACUCGCCCGA | ((((((....))))))((((....))))... |
| >1025 | TGTGTTGTCGTTGCCTCC | 20 | 0 | 0 | 1 | 1 | 4 | GGGAGGACGAUGCGGUGUGUUGUCGUUGCCUCCCAGACGACUCGCCCGA | (((((((....)))))))(((....))))... |
| >1026 | TTTGGATTTTCCCGTGCC | 20 | 0 | 0 | 3 | 3 | 0 | GGGAGGACGAUGCGGUUUGGAUUUUCCCGUGCCCAGACGACUCGCCCGA | ((((((((....))))))))(((((....)))))... |
| >1027 | TTTGGGGTCTTTCCCTGCC | 20 | 0 | 0 | 2 | 1 | 0 | GGGAGGACGAUGCGGUUUGGGGUCUUUCCCUGCCCAGACGACUCGCCCGA | ((.((.(((....))).)))).((((....)))) |
| >1028 | TTTGGGGTTTCTCCCGTCC | 20 | 0 | 0 | 1 | 2 | 0 | GGGAGGACGAUGCGGUUUGGGGUUUCUCCCGUCCCAGACGACUCGCCCGA | ((.((.(((....))).))))((((....)))) |
| >1029 | TTTGTCGTCGTCGTCC | 19 | 0 | 0 | 1 | 0 | 2 | GGGAGGACGAUGCGGUUUGUCGUCGUCGUCCCAGACGACUCGCCCGA | (((.((....)))).((((....))))... |
| >1030 | ATGTATGTTGGGGCCACGC | 20 | 0 | 1 | 0 | 3 | 0 | GGGAGGACGAUGCGGAUGUAUGUUGGGGCCACGCCAGACCACGCCCGA | ((((.((((....)))).)))).(((((....)))))... |
| >1031 | GCCCTCGTTTGGTTCGTCC | 20 | 0 | 1 | 1 | 0 | 1 | GGGAGGACGAUGCGGGCCCUCGUUUGGUUCGUCCCAGACGACUCGCCCGA | (((.((....))))((((....))))... |
| >1032 | TCCTGTCGTTCGTCC | 19 | 0 | 1 | 2 | 3 | 0 | GGGAGGACGAUGCGGUCACAGUGUCCCGUGUGCCAGACGACUCGCCCGA | ((((.((((....)))).))))(((((....)))))... |
| >1033 | TTCTGTCGTCGTTCGTCTC | 20 | 0 | 1 | 0 | 0 | 1 | GGGAGGACGAUGCGGUUCUGUCGUCGUUCGUCUCCAGACUCGCCCGA | ((..((....))))((((....))))... |
| >1034 | TTGGGGTTTTCCCGTGCTC | 20 | 0 | 1 | 2 | 3 | 0 | GGGAGGACGAUGCGGUUGGGGUUUCCCGUGCUCCAGACGACUCGCCCGA | ((((((((....))))))))(((((....)))))... |
| >1035 | TTTGGGGTTTTCGTGCCC | 19 | 0 | 1 | 1 | 0 | 1 | GGGAGGACGAUGCGGUUUGGGGUUUUCGUGCCCCAGACGACUCGCCCGA | ((((((((....))))))))(((((....)))))... |
| >1036 | TATATGTTCGTCACTCGCTG | 20 | 0 | 2 | 5 | 2 | 0 | GGGAGGACGAUGCGGUAUAUGUUCGUCACUCGCUGCCAGACGACUCGCCCGA | ((((.((....))))))(((((....)))))... |
| >1037 | TCTGACGAGACTCCCATCGC | 20 | 0 | 2 | 0 | 2 | 0 | GGGAGGACGAUGCGGUCUGACGAGACUCCCAUCGCCAGACUCGCCCGA | ((..((....))))((((....))))... |
| >1038 | TTTGGGGTATTCCTCGGCCC | 20 | 0 | 2 | 1 | 1 | 0 | GGGAGGACGAUGCGGUUUGGGGUAUUCCUCGGCCCAGACGACUCGCCCGA | ((((.((((....)))).))))(((((....)))))... |
| >1039 | TTTGGGTTTTCCCGTGCC | 20 | 0 | 2 | 0 | 0 | 0 | GGGAGGACGAUGCGGUUUGGGUUUUCCCGUGCCCAGACGACUCGCCCGA | ((((((((....))))))))(((((....)))))... |
| >1040 | TCTACAGTGTCCCGTGTG | 20 | 0 | 5 | 1 | 5 | 0 | GGGAGGACGAUGCGGUCUACAGUGUCCCGUGUGCCAGACGACUCGCCCGA | ((((.((((....)))).))))(((((....)))))... |
| >1041 | ACCTGACGTCTGTTCGTCC | 20 | 0 | 0 | 4 | 2 | 0 | GGGAGGACGAUGCGGACCUGACGUCUGUUCGUCCCAGACGACUCGCCCGA | (((((.((....)))).))).((((....))))... |
| >1042 | ACCTGGCTTGTCGTTGTCC | 20 | 0 | 0 | 4 | 2 | 1 | GGGAGGACGAUGCGGACCUGGCUUGUCGUUGUCCCAGACGACUCGCCCGA | (((((.((....)))).))).((((....))))... |
| >1043 | ACCTGTCGTCGATCGTCC | 20 | 0 | 0 | 1 | 0 | 0 | GGGAGGACGAUGCGGACCUGUCGUCGAUCGUCCCAGAGGACUCGCCCGA | ((((((....))))))((((....))))... |
| >1044 | ACCTGTCGTGTTCATCCC | 20 | 0 | 0 | 1 | 3 | 2 | GGGAGGACGAUGCGGACCUGUCGUGUUCAUCCCCAGACGACUCGCCCGA | ((((((....))))))((((....))))... |
| >1045 | ACCTTGTCGTCGACCTCC | 20 | 0 | 0 | 1 | 0 | 1 | GGGAGGACGAUGCGGACCUUGUCGUCGACCUCCCAGACUCCUCGCCCGA | ((((((....))))))((((....))))... |
| >1046 | ACTCGCTGGTTGCCGGC | 20 | 0 | 0 | 3 | 3 | 1 | GGGAGGACGAUGCGGACUGCUGGUUGCCGGCCCGCCGCCCAGACGACUCGCCCGA | ((((((....))))))((((....))))... |
| >1047 | ATATCCAGTCTATGGCCCG | 20 | 0 | 0 | 3 | 1 | 0 | GGGAGGACGAUGCGGAUAUCCAGUCUAUGGCCCCGCAGAGACGACUCGCCCGA | ((((((....))))))((((....))))... |
| >1048 | ATCTGGGGTTTTCCTGCCC | 20 | 0 | 0 | 2 | 3 | 0 | GGGAGGACGAUGCGGAUCUGGGGUUUUCCUGCCCCAGAGGACUCGCCCGA | ((((((....)))))).((((....))))... |
| >1049 | CACAGTTCGTCGCGTCCC | 20 | 0 | 0 | 1 | 1 | 1 | GGGAGGACGAUGCGGCACAGUUCGUCGCGUCCCCAGACGACUCGCCCGA | (((((((....))))))).((((....))))... |
| >1050 | CAGATCGTCTGTGCCTCC | 20 | 0 | 0 | 1 | 1 | 2 | GGGAGGACGAUGCGGCAGAUCGUCUGUGCCUCCCAGACGACUCGCCCGA | (((((.((....)))).))).((((....))))... |
| >1051 | CAGTGTCTTTTTTGTCCC | 21 | 0 | 0 | 1 | 3 | 0 | GGGAGGACGAUGCGGCAGUGUCUUUUUUGUCCCCAGACGACUCGCCCGA | (((((((....))))))).((((....))))... |
| >1052 | CCAGTTGATCTGTCCCTCC | 20 | 0 | 0 | 1 | 2 | 1 | GGGAGGACGAUGCGGCCAGUUGAUCUGUCCCUCCCAGACGACUCGCCCGA | ((((((((....))))))))((((....))))... |
| >1053 | CCCTGACGTTCGTTCC | 20 | 0 | 0 | 0 | 0 | 0 | GGGAGGACGAUGCGGCCCUGACGUUCGUUCCCCAGACGACGCCCGA | ((((((....)))))).((((....))))... |
| >1054 | CCCTGTCGTTCGACCCC | 20 | 0 | 0 | 0 | 0 | 2 | GGGAGGACGAUGCGGCCCUGUCGUUCGACCCCCAGACGACUCGCCCGA | (((((((....))))))).((((....))))... |
| >1055 | CCCTGTCGTCGTTCGGCCC | 20 | 0 | 0 | 1 | 2 | 2 | GGGAGGACGAUGCGGCCCUGUCGUCGUUCGGCCCCAGACUCGCCCGA | (((((((....))))))).((((....))))... |

| ID | Seq1 | | | | | Sequence | Structure |
|---|---|---|---|---|---|---|---|
| >2443 | TTTCGGGTTTTTCCCGTGCCC | 20 | 1 | 1 | 0 | 0 | GGGAGGACGAUGGGUUUCGGGUUUUCCCGUGCCCCCAGAGACGACUCGCCCGA | (((((..(((..(((..(((((.....))))).....)))).)).)))))... |
| >2444 | TTTGCCACATTCCCGTGTG | 20 | 1 | 1 | 0 | 0 | GGGAGGACGAUGGGUUUGCCACAUCCCGUGUGCAGACGACUCGCCCGA | (((..(((..(..(((((........))))).)).))))).. |
| >2445 | TTTGGGGATTTCCTGCCCC | 19 | 1 | 2 | 0 | 1 | GGGAGGACGAUGGGUUUGGGGAUUUCCUGCCCCAGACGACUCGCCCGA | (((..(((..(..(((((......))))).)).))))).. |
| >2446 | TTTGGGGTTCTTTCCCGTACCC | 21 | 1 | 0 | 1 | 0 | GGGAGGACGAUGGGUUUGGGGUUCUUUCCCGUACCCAGACGACUCGCCCGA | ((((..(((..(..(((((......))))).)).))))).. |
| >2447 | TTTGGGGTTTCTTCCCCCC | 20 | 1 | 1 | 1 | 0 | GGGAGGACGAUGGGUUUGGGGUUUCUUCCCCCCAGACGACUCGCCCGA | (((((..(((..(((..(((((.....))))).....)))).)).)))))... |
| >2448 | TTTGGGGTTTCTTCCCGCC | 19 | 1 | 1 | 2 | 0 | GGGAGGACGAUGGGUUUGGGGUUUCUUCCCGCCAGACGACUCGCCCGA | (((..(((..(((..(((((........))))).....)).))))))... |
| >2449 | TTTGGGGTTTCTTCTGCCC | 20 | 1 | 1 | 2 | 0 | GGGAGGACGAUGGGUUUGGGGUUUCUUCUCGCCCAGACGACUCGCCCGA | (((..(((..(..(((((........))))).)).))))).. |
| >2450 | TTTGGGGTTTCCCGTGCGC | 20 | 1 | 1 | 2 | 0 | GGGAGGACGAUGGGUUUGGGGUUUCCCGUGCGCCAGACGACUCGCCCGA | (((..(((..(..(((((........))))).)).))))).. |
| >2451 | TTTGTCTGGGATTGCCGCCC | 20 | 1 | 1 | 0 | 1 | GGGAGGACGAUGGGUUUGUCUGGGAUUGCCGCCCAGACGACUCGCCCGA | ....((..(((..(..(((((.....))))).)).))))... |
| >2452 | TTTGTGTGTTACTTTGCCGC | 20 | 2 | 0 | 1 | 0 | GGGAGGACGAUGGGUUUGUGUGUUACUUUGCCGCAGACGACUCGCCCGA | (((..(((..(..(.(((..)))).)).))))... |
| >2453 | ATGGTGTTGGGAGCCACGG | 20 | 2 | 1 | 0 | 0 | GGGAGGACGAUGGGAUGGUGUUGGGAGCCACGGCAGACGACUCGCCCGA | (((..(((..(..(((((......))))).)).))))).. |
| >2454 | TCTACACATATCCCGTGTG | 20 | 2 | 0 | 1 | 0 | GGGAGGACGAUGGGUCUACACAUAUCCCGUGUGACGACGACUCGCCCGA | (((..(((..(..(((((......))))).)).))))).. |
| >2455 | TCTACACATTTCCCGTTGTG | 20 | 2 | 0 | 1 | 0 | GGGAGGACGAUGGGUCUACACAUUUCCCGUUGUGAGACGACUCGCCCGA | (((..(((..(..(((((......))))).)).))))).. |

NUCLEIC ACID APTAMERS

RELATED APPLICATIONS

This patent application claims the benefit of priority of U.S. Application Ser. No. 61/682,055, filed Aug. 10, 2012, and U.S. Application Ser. No. 61/792,723, filed Mar. 15, 2013, which applications are incorporated by reference herein.

SEQUENCE LISTING

The instant application contains a Sequence Listing which has been submitted in ASCII format via EFS-Web and is hereby incorporated by reference in its entirety. Said ASCII copy, created on Sep. 19, 2013, is named 17023.129US1_SL.txt and is 1,105,607 bytes in size.

FEDERAL GRANT SUPPORT

This invention was made with government support under Grant No. CA138503 awarded by the National Institutes of Health. The government has certain rights in the invention.

BACKGROUND OF THE INVENTION

Vascular stenosis is a narrowing or stricture on the interior portion of the blood vessel wall, usually caused by atherosclerosis. This narrowing can progress in a generally asymptomatic manner slowly through the course of an individual's life. However, if a segment of the built-up plaque that contributed to the stenosis breaks off it can initiate a series of events that cause heart attack or stroke. Alternatively, progressive narrowing of the vessel can lead to tissue ischemia.

When stenosis is diagnosed (usually in cases of angina), patients may receive a surgically-implanted stent, which is a very small tube shaped device with a firm or hard-walled structure. This device is implanted at the site of the plaque build-up to hold the artery open and prevent the plaque build-up from being symptomatic.

Experience has shown, however, that stenting itself often promotes restenosis. In other words, during the healing process, migration and fibrosis of vascular smooth muscle cells (VSMCs) can be stimulated, resulting in growth of the cells around the stent, thus creating an issue similar to the original one which called for stenting in the first place. In order to prevent this, advanced stents have been impregnated with drugs (drug eluting stent or DES) to limit the occurrence of restenosis from fibrosis or clot formation. DES that have been approved for use in the clinic elute drugs such as sirolimus, paclitaxel, everolimus in low doses into the stent microenvironment to prevent unwanted cell migration or proliferation during the initial stages of the healing process.

The therapeutic agents used in drug eluting stents are generally antiproliferative agents. In other words, they are equally effective at preventing replication of all the cell types in the microenvironment of the stent. However, the patient needs to produce endothelial cells along the surface of their arteries to prevent the spontaneous activation of platelets and the formation of clots. This event is currently prevented during the recovery period by treating the patient with system antithrombic agents ("blood thinners"), which can instigate their own issues in the patient population. Thus, there is an on-going need for drug-eluting stents that are impregnated with therapeutics that preferentially eliminate the migration and proliferation of VSMCs and allow the post-surgery regrowth of vascular endothelial cells, so that patient recovery is quicker and the prognosis is better. There is also a need for compositions and methods for local delivery of therapeutic compounds into the vascular wall or for intra-venous/intra-arterial delivery.

SUMMARY OF THE INVENTION

Certain embodiments of the present invention provide a nucleic acid molecule not more than 100 nucleotides in length (e.g., 50-90 nt) comprising any one of the aptamers listed in FIG. 12. In certain embodiments, the aptamer is aptamer-1, aptamer-2, aptamer-3, aptamer-4, aptamer-5, aptamer-6, aptamer-8, aptamer-9, aptamer-11, aptamer-13, aptamer-14, aptamer-15, aptamer-17, aptamer-19, aptamer-21, aptamer-23, aptamer-26, aptamer-27, aptamer-28, aptamer-29, aptamer-35, aptamer-36, aptamer-41, aptamer-51, aptamer-53, aptamer-55, aptamer-58, aptamer-62, aptamer-71, aptamer-81, aptamer-89, aptamer-229, or aptamer-420. In certain embodiments, the nucleotides are RNA. In certain embodiments, the nucleic acid of the present invention is DNA. In certain embodiments, the RNA includes a modified nucleotide. In certain embodiments, the RNA is chemically modified (T-fluoropyridines).

Certain embodiments of the present invention provide a conjugate comprising the nucleic acid molecule described above linked to a therapeutic or diagnostic molecule. In certain embodiments, the therapeutic molecule is an RNAi molecule. In certain embodiments, the RNAi molecule is an siRNA molecule or an miRNA molecule. In certain embodiments, "linked" includes directly linking (covalently or non-covalently binding) the nucleic acid molecule of the invention (e.g., an aptamer) to a therapeutic or diagnostic molecule. In certain embodiments, "linked" includes linking the nucleic acid molecule of the invention (e.g., an aptamer) to a therapeutic or diagnostic molecule using a linker, e.g., a nucleotide linker, e.g., the nucleotide sequence "AA" or "TT" or "UU".

Certain embodiments of the present invention provide a method for delivering a therapeutic or diagnostic molecule to a vascular smooth muscle cell, comprising contacting the cell with the conjugate described above.

Certain embodiments of the present invention provide a pharmaceutical composition comprising a molecule or conjugate as described above and a pharmaceutically acceptable carrier.

Certain embodiments of the present invention provide a method for treating a patient having vascular disease comprising administering a molecule or conjugate as described above to the patient.

Certain embodiments of the present invention provide a use of a molecule or conjugate as described above for treating vascular disease.

Certain embodiments of the present invention provide a method for treating a patient having or being disposed to having vascular stenosis or restenosis comprising administering a molecule or conjugate as described above to the patient.

Certain embodiments of the present invention provide a molecule or conjugate as described above for use in therapy.

Certain embodiments of the present invention provide a molecule or conjugate as described above for use in the prophylactic or therapeutic treatment of vascular disease.

Certain embodiments of the present invention provide an article of manufacture comprising a solid substrate coated with the molecule or conjugate as described above. In certain embodiments, the solid substrate is a stent, catheter, a catheter hub, a catheter port, or a non-degradable implant.

Certain embodiments of the present invention provide a method of isolating cell-internalized RNA comprising:

(a) contacting an initial RNA pool, consisting of RNA sequences derived from a duplex DNA library using in vitro transcription, with a non-target cell to generate unbound RNA and bound RNA and remove the bound RNA;

(b) contacting the unbound RNA with a target cell to generate cell-bound RNA, cell-unbound RNA, and cell-internalized RNA;

(c) wash the target cell with a stringent salt solution; and (d) isolate the cell-internalized RNA, wherein RNA in the RNA pool is not more than 90 nucleotides in length. The RNA pool can vary in length (e.g., 50-90 nt). The RNAs in the pool contain a central region of unique sequence of about 15-25 nucleotides (such as 20 nucleotides) flanked by constant sequence regions of about 10-20 nucleotides (such as about 15 or 16 nucleotides).

In certain embodiments, the method further comprises (e) reverse transcribing and PCR amplifying the cell-internalized RNA to generate a secondary RNA pool.

In certain embodiments, the method further comprises (f) obtaining a sample from the secondary RNA pool, (g) performing high throughput sequencing (HTS) to obtain raw reads of unique sequences and non-unique sequences, (h) filtering the raw reads based on RNA library constant region sequences to obtain filtered reads, (i) determining which filtered reads are selected sequences and which are non-selected sequences, and (j) analyzing a database of selected sequences for candidate sequences by calculating the fold enrichment of HTS reads between two rounds of selection. In certain embodiments, fold enrichment two rounds of selection that are analyzed is a comparison of the fold enrichment of round 3 to round 8.

As used herein, the term "selected sequences" are sequences enriched by the SELEX process, and "non-selected sequences" are background sequences indicative of the unenriched starting RNA pool. In certain embodiments, the 5'constant sequence is HTS DNA sequence=5'-GGGAG-GACGATGCGG-3' (SEQ ID NO: 1); and the 3' constant sequence is HTS DNA sequence=5'-CAGACGACTCGC-CCGA-3' (SEQ ID NO: 2). In certain embodiments, the present invention provides a method of identifying a true-selected sequence by obtaining the number of times a unique sequence appears in each round of selection (cluster size), wherein true-selected sequence is a unique sequence that appears in at least three rounds of selection.

In certain embodiments, the present invention provides a method of identifying a true-selected sequence by comparing the unique sequences of different rounds of selection, and identifying a unique sequence present in at least two rounds of selection. A "unique sequence" is defined as each individual sequence is a sequence different from all other unique sequences. As used herein the term "total sequences" is defined as the number of HTS reads for a given unique sequence. As used herein a "round of selection" is a process involving steps (a)-(i). In certain embodiments, the method further comprising obtaining the number of times a unique sequence appeared in each round of selection. In certain embodiments, the method further comprises determining the edit distance of the unique sequences as compared to the other sequences in the round of selection. Edit as defined by the Vienna Package edit distance is the "minimum sum of the costs along an edit path converting one object into the other" (costs=insertion, deletion and replacement). The edit distance is the number of changes (substitution/insertion/deletion) necessary for two sequences to become identical. For example, closely-related sequences have a low edit distance, while unrelated or loosely-related sequences are denoted by a high edit distance.

In certain embodiments, the method further comprises determining the tree distance of the unique sequences as compared to the other sequences in the round of selection. Tree distance as defined by the Vienna Package tree distance uses the same cost calculations (cost=insertion, deletion and replacement) but takes into account the bracket pairing of the predicted RNA structure when determining the minimum sum of costs to convert one object into the other. "Tree distance" describes the relatedness of two structures by calculating the dissimilarity between two structures. Analogous with edit distance, closely-related structures have a low tree distance, while unrelated or loosely-related structures are denoted by a large tree distance. In certain embodiments, the present invention provides an aptamer having a true-selected sequence present in at least two rounds of selection, having a cluster size of at least 3, having an edit distance of 1, and having a tree distance of less than 3.

The present invention further provides a nucleic acid coding molecule encoding a nucleic acid aptamer molecule as described above. The present invention further provides an expression cassette comprising the nucleic acid coding molecule described above. In certain embodiments, the expression cassette further includes a promoter, such as a regulatable promoter or a constitutive promoter. Examples of suitable promoters include a CMV, RSV, pol II or pol III promoter. The expression cassette may further contain a polyadenylation signal (such as a synthetic minimal polyadenylation signal) and/or a marker gene. Examples of marker genes include visual markers such as GFP, or functional markers, such as antibiotic resistance genes.

In certain embodiments, the expression cassette is contained in a vector, such as a viral vector or a plasmid vector. Certain embodiments of the invention provide a vector, e.g., a viral vector, including at least one (e.g., 1 or 2) expression cassette of the invention. Examples of appropriate vectors include adenoviral, lentiviral, adeno-associated viral (AAV), poliovirus, HSV, or murine Maloney-based viral vectors. In one embodiment, the vector is an adenoviral vector. In certain embodiments, a vector may contain two expression cassettes.

Certain embodiments of the invention provide an isolated or non-human cell including the PMSA receptor and a molecule or conjugate of the invention. The present invention relates to a specific delivery of siRNAs and one that, at least in one embodiment, only uses properties of RNA. The delivery method of the instant invention exploits the structural potential of nucleic acids (e.g., RNA) to target siRNAs to a particular cell-surface receptor and thus to a specific cell type. In one embodiment, the invention provides a method and compositions to specifically deliver nucleic acids that comprise both a targeting moiety (e.g., an aptamer) and an RNA-silencing moiety (e.g., an siRNA) that is recognized and processed by Dicer in a manner similar to the processing of microRNAs. Aptamers and siRNAs have low immunogenicity. They can easily be synthesized in large quantities at a relatively low cost and are amendable to a variety of chemical modifications that confer both resistance to degradation and improved pharmacokinetics in vivo. The smaller size of aptamers compared with that of antibodies (<15 kDa versus 150 kDa) facilitates their in vivo delivery by promoting better tissue penetration.

In certain embodiments of the invention, RNAi molecules are employed to inhibit expression of a target gene. By "inhibit expression" is meant to reduce, diminish or suppress expression of a target gene. Expression of a target gene may be inhibited via "gene silencing." Gene silencing refers to the suppression of gene expression, e.g., transgene, heterologous gene and/or endogenous gene expression, which may be mediated through processes that affect transcription and/or through processes that affect post-transcriptional mechanisms. In some embodiments, gene silencing occurs when an RNAi molecule initiates the degradation of the mRNA transcribed from a gene of interest in a sequence-specific manner via RNA interference, thereby preventing translation of the gene's product.

As used herein the term "encoded by" is used in a broad sense, similar to the term "comprising" in patent terminology. For example, the statement "the first strand of RNA is encoded by SEQ ID NO:1" means that the first strand of RNA sequence corresponds to the RNA sequence transcribed from the DNA sequence indicated in SEQ ID NO:1, but may also contain additional nucleotides at either the 3' end or at the 5' end of the RNA molecule.

The reference to siRNAs herein is meant to include short hairpin RNAs (shRNAs) and other small RNAs that can or are capable of modulating the expression of a target gene, for example via RNA interference. Such small RNAs include without limitation, shRNAs and miroRNAs (miRNAs). The two strands of RNA in the siRNA may be completely complementary, or one or the other of the strands may have an "overhang region" (i.e., a portion of the RNA that does not bind with the second strand). Such an overhang region may be from 1 to 10 nucleotides in length.

This invention relates to compounds, compositions, and methods useful for inhibiting a target gene expression using short interfering nucleic acid (siRNA) molecules. This invention also relates to compounds, compositions, and methods useful for modulating the expression and activity of the target gene by RNA interference (RNAi) using small nucleic acid molecules. In particular, the instant invention features small nucleic acid molecules, such as short interfering nucleic acid (siNA), short interfering RNA (siRNA), double-stranded RNA (dsRNA), micro-RNA (miRNA), and short hairpin RNA (shRNA) molecules and methods used to modulate the expression of target genes. A siRNA of the instant invention can be chemically synthesized, expressed from a vector or enzymatically synthesized.

In the present invention, an expression cassette may contain a nucleic acid encoding at least one strand of the RNA duplex described above. Such an expression cassette may further contain a promoter. The expression cassette may be contained in a vector. These cassettes and vectors may be contained in a cell, such as a mammalian cell. A non-human mammal may contain the cassette or vector. The vector may contain two expression cassettes, the first expression cassette containing a nucleic acid encoding the first strand of the RNA duplex, and a second expression cassette containing a nucleic acid encoding the second strand of the RNA duplex.

The present invention further provides a method of substantially silencing a target gene of interest or targeted allele for the gene of interest in order to provide a therapeutic effect. As used herein the term "substantially silencing" or "substantially silenced" refers to decreasing, reducing, or inhibiting the expression of the target gene or target allele by at least about 5%, 10%, 15%, 20%, 25%, 30%, 35%, 40%, 45%, 50%, 55%, 60%, 65%, 70%, 75%, 80%, 85% to 100%. As used herein the term "therapeutic effect" refers to a change in the associated abnormalities of the disease state, including pathological and behavioral deficits; a change in the time to progression of the disease state; a reduction, lessening, or alteration of a symptom of the disease; or an improvement in the quality of life of the person afflicted with the disease. Therapeutic effect can be measured quantitatively by a physician or qualitatively by a patient afflicted with the disease state targeted by the siRNA. In certain embodiments wherein both the mutant and wild type allele are substantially silenced, the term therapeutic effect defines a condition in which silencing of the wild type allele's expression does not have a deleterious or harmful effect on normal functions such that the patient would not have a therapeutic effect.

In one embodiment, the expression vectors are constructed using known techniques to at least provide as operatively linked components in the direction of transcription, control elements including a transcriptional initiation region, the DNA of interest and a transcriptional termination region. The control elements are selected to be functional in a mammalian cell. The resulting construct which contains the operatively linked components is flanked (5' and 3') with functional sequences, such as sequences encoding an aptamer and/or siRNA.

In one embodiment, the selected nucleotide sequence is operably linked to control elements that direct the transcription or expression thereof in the subject in vivo. Such control elements can comprise control sequences normally associated with the selected gene. Alternatively, heterologous control sequences can be employed. Useful heterologous control sequences generally include those derived from sequences encoding mammalian or viral genes. Examples include, but are not limited to, the SV40 early promoter, mouse mammary tumor virus LTR promoter; adenovirus major late promoter (Ad MLP); a herpes simplex virus (HSV) promoter, a cytomegalovirus (CMV) promoter such as the CMV immediate early promoter region (CMVIE), a rous sarcoma virus (RSV) promoter, pol II promoters, pol III promoters, synthetic promoters, hybrid promoters, and the like. In addition, sequences derived from nonviral genes, such as the murine metallothionein gene, will also find use herein. Such promoter sequences are commercially available from, e.g., Stratagene® (San Diego, Calif.).

In one embodiment, pharmaceutical compositions will comprise sufficient genetic material to produce a therapeutically effective amount of the siRNA of interest, i.e., an amount sufficient to reduce or ameliorate symptoms of the disease state in question or an amount sufficient to confer the desired benefit. The pharmaceutical compositions will also contain a pharmaceutically acceptable excipient. Such excipients include any pharmaceutical agent that does not itself induce the production of antibodies harmful to the individual receiving the composition, and which may be administered without undue toxicity. Pharmaceutically acceptable excipients include, but are not limited to, sorbitol, Tween80, and liquids such as water, saline, glycerol and ethanol. Pharmaceutically acceptable salts can be included therein, for example, mineral acid salts such as hydrochlorides, hydrobromides, phosphates, sulfates, and the like; and the salts of organic acids such as acetates, propionates, malonates, benzoates, and the like. Additionally, auxiliary substances, such as wetting or emulsifying agents, pH buffering substances, and the like, may be present in such vehicles. A thorough discussion of pharmaceutically acceptable excipients is available in REMINGTON'S PHARMACEUTICAL SCIENCES (Mack Pub. Co., N.J. 1991).

Eight rounds of selection were performed to enrich for RNA aptamer sequences that selectively internalizes into the target VSMCs. Non-specific aptamers were removed by pre-clearing against endothelial cells (ECs; non-target). (B-D) Progression of the selection and complexity of the RNA pools was monitored using a DNA melt assay at (B) rounds 0-3, (C) rounds 3-6 and (D) rounds 6-8. (E) The RNA pools at each round of selection were tested for internalization into VSMCs and ECs using quantitative RT-PCR(RT-qPCR). These data were normalized to an internal RNA reference control for the PCR and to cell number.

Figure 2:
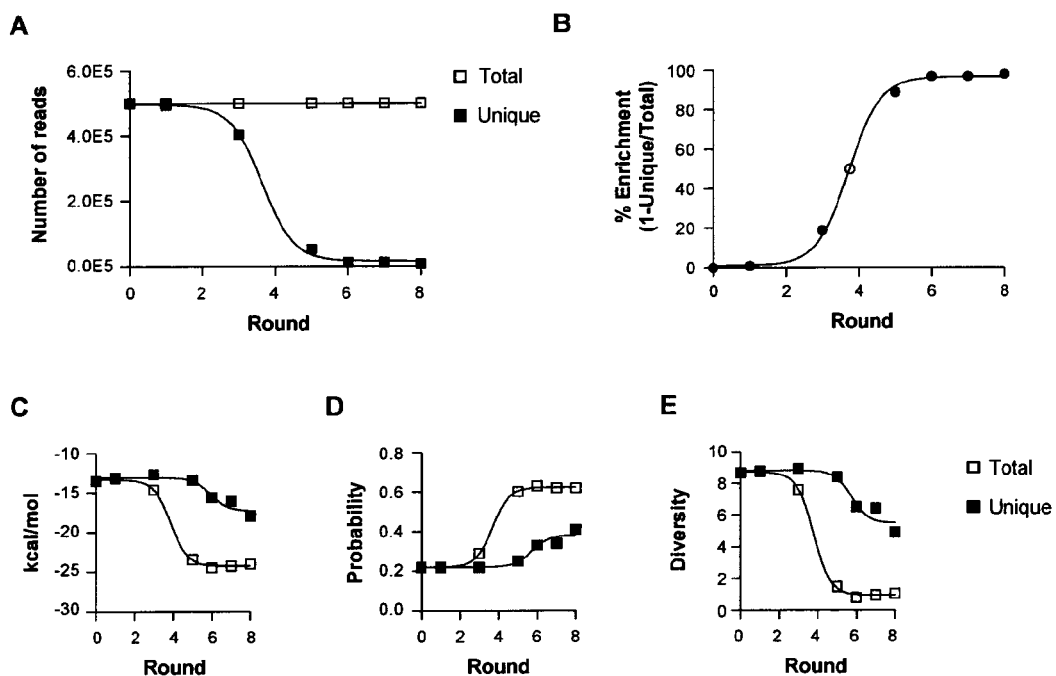

FIG. 2. Assessment of selection progression. (A) RNA aptamer pools from rounds 0, 1, 3, 5, 6, 7 and 8 were sequenced using Illumina sequencing technology. The number of unique reads (black squares) and total reads (white squares) was determined at each round of selection. (B) % Enrichment at each round (black circle) was determined by the formula (% Enrichment=1−Unique/Total). A sigmoidal curve fit was used to determine the round at which 50% sequence enrichment was achieved (white circle). The average (C) minimum free energy (D) ensemble probability and (E) ensemble diversity at each selection round was calculated for the unique reads (black squares) and for the total reads (white squares) using RNAfold secondary structure prediction algorithm.

Figure 3:
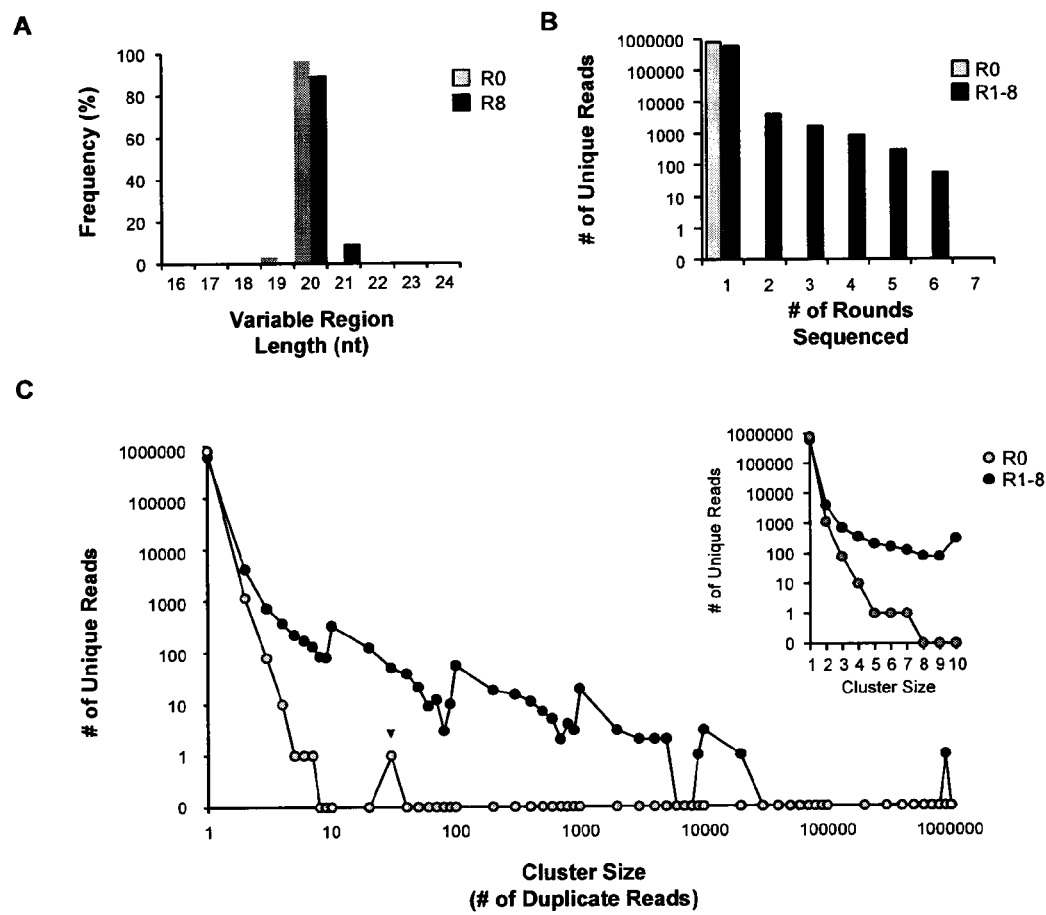

FIG. 3. Bioinformatics analysis of high-throughput sequence data from selection rounds. (A) The RNA sequences from rounds 0 (gray bars) and 8 (black bars) of selection were examined for frequency of variable region nucleotide (nt) length (ranging from 16 nt-24 nt). (B) Number of unique reads from round 0 (gray circles) and rounds 1-8 (black circles) vs. number of rounds sequenced. (C) Number of unique reads from round 0 (gray circles) and rounds 1-8 (black circles) vs. cluster size. A single sequence (V) containing a string of cytosine was found 30 times within round 0.

Figure 4:
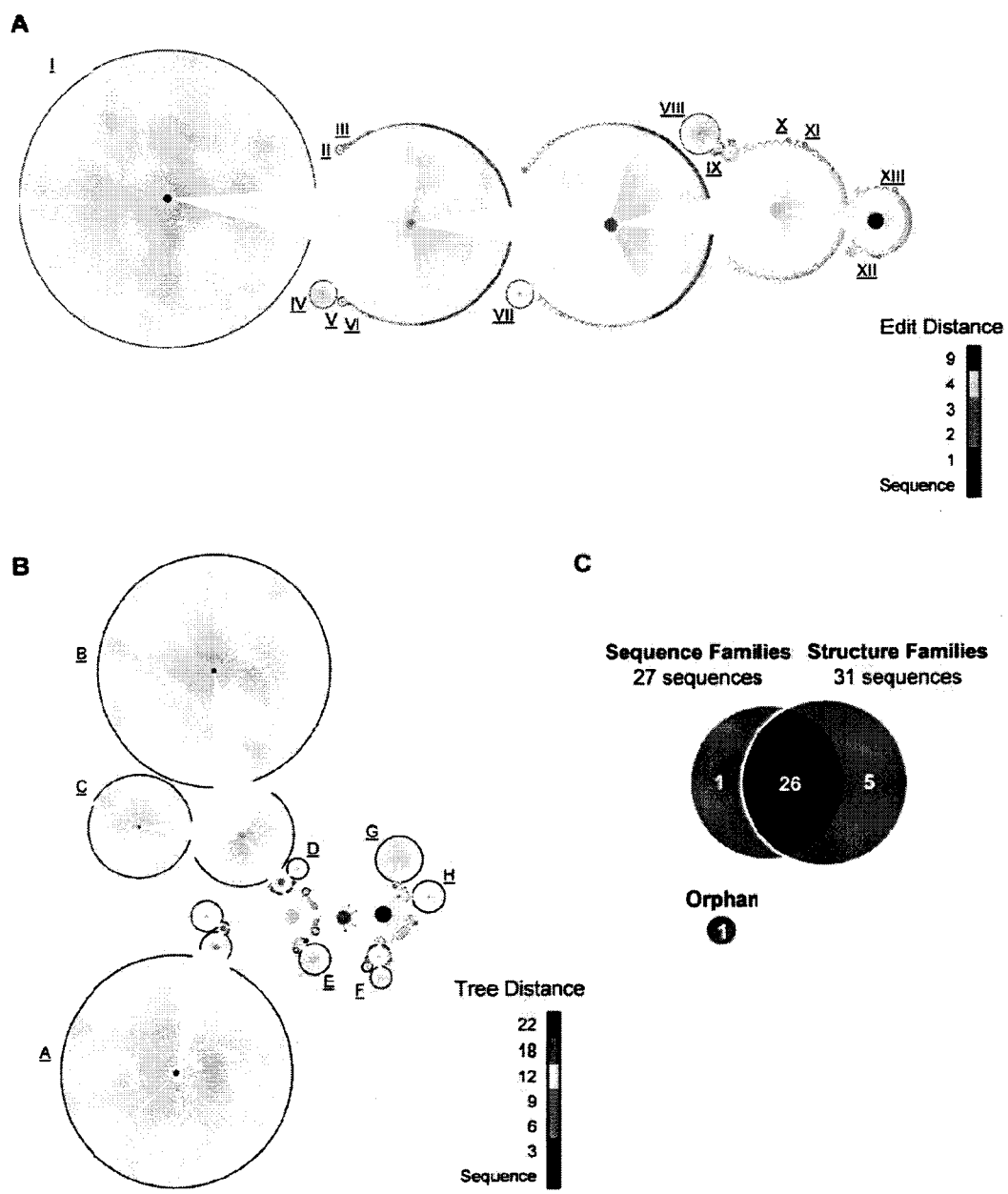

FIG. 4. Bioinformatics analysis of RNA aptamers to identify related sequence and structure families. (A) RNA aptamer unique sequences (black) are connected to nodes of increasing edit distance (1-9; blue to red color scale). Related sequence families were identified as RNA aptamer sequences that connected by an edit distance of 1 (I-XIII). (B) RNA aptamer sequences (black) were connected to nodes of increasing tree distance (0-18; blue to red color scale). Related structure families were identified as RNA aptamer sequences with structures connected by a tree distance of 3 to 6 (A-H). (C) Venn Diagram of RNA sequences identified based on the edit distance (27 sequences) and tree distance (31 sequences) analyses. Orphan: a highly represented sequence that did not fall into a sequence or structure family.

Figure 5:
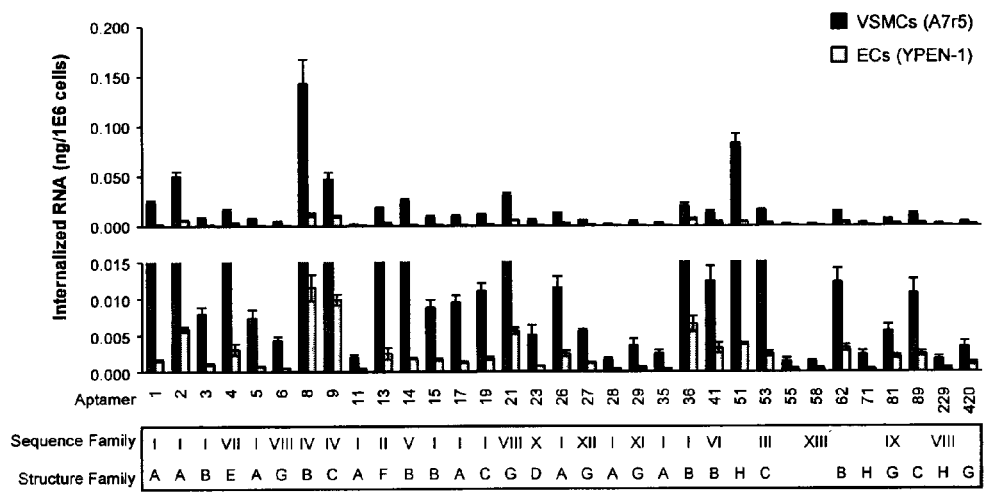
Figure 5:
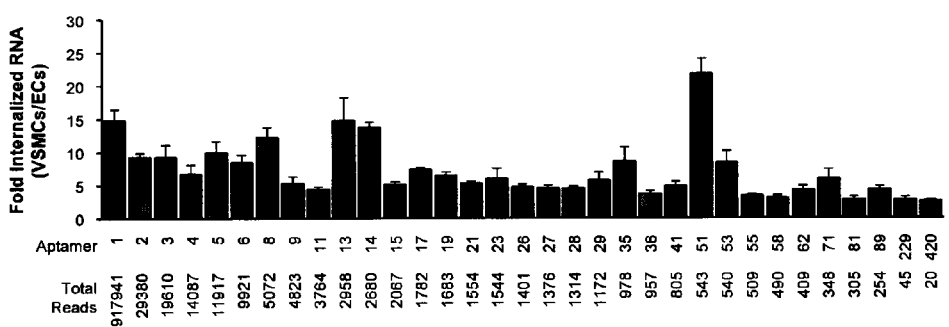

FIG. 5. VSMC-specific internalization of candidate RNA aptamers. (A) Internalization of individual RNA aptamer sequences derived from the bioinformatics analysis in FIG. 4 was assessed in both VSMCs and ECs by RT-PCR (RT-qPCR). The data are normalized to a reference control RNA and to cell number. Internalized RNA data (ng/1,000,000 cells) are plotted on a full scale (top panel) as well as on an expanded scale (middle panel). Table (bottom panel) indicates the sequence and/or structure family of each RNA aptamer sequence. (B) Relative fold internalization (VSMCs/ECs) was determined for each RNA aptamer sequence.

Figure 6:
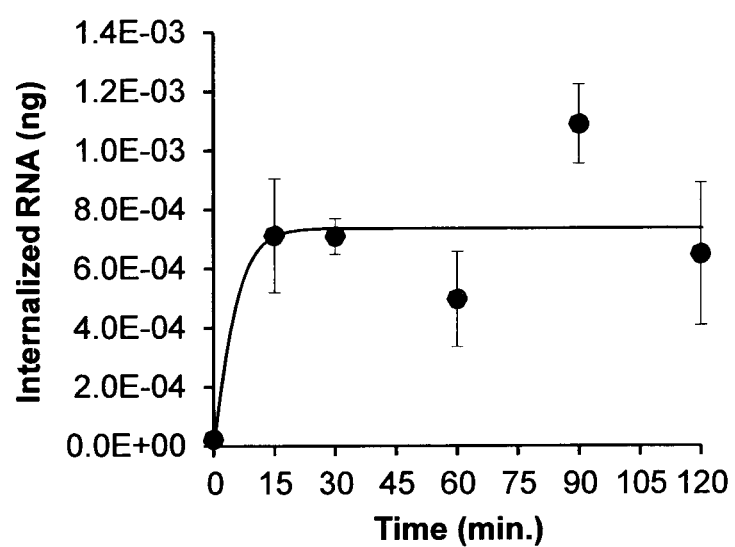

FIG. 6. Amount of RNA aptamer library (Round 0) internalized into VSMCs over time. Round 0 RNA was incubated with VSMCs (A7r5) for 15, 30, 60, 90 or 120 minutes. Unbound RNA or RNA bound to the surface of cells was removed with a stringent salt wash. Internalized RNA was extracted by TRIzol extraction and measured using RT-qPCR.

Figure 7:
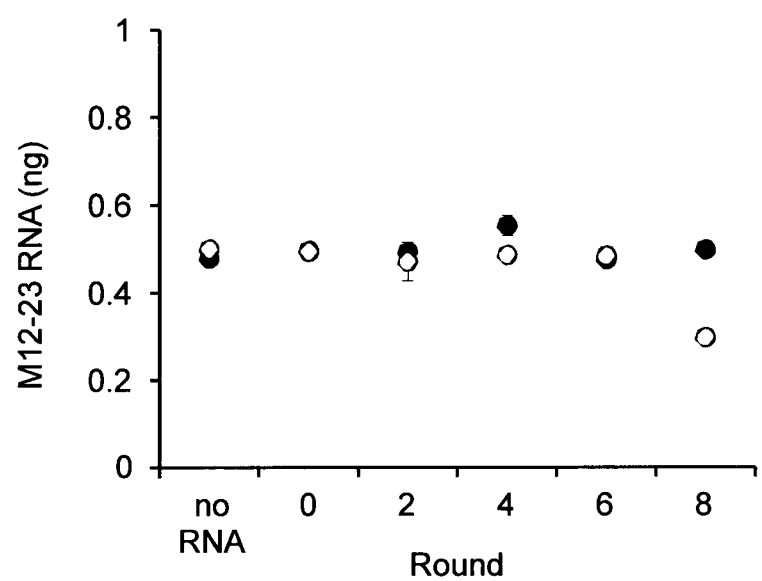

FIG. 7. Recovery of RNA processing control. The M12-23 reference control RNA was added to TRIzol prior to cell lysis as a control for processing of internalized RNA. The reference control M12-23 RNA was measured by RT-qPCR. Internalized RNA data was normalized to each paired processing M12-23 reference control RNA.

Figure 8:

FIG. 8. Edit distance 1 output from process.seqs program. Unique sequences (black nodes) interconnect by edges (lines) at edit distance 1 (blue lines). This analysis resulted in several sequence clusters (1 edit distance apart) as well as orphan sequences that did not fall within a sequence cluster (individual nodes not interconnected by blue lines). This data output was used to generate the dendrogram in FIG. 4A, which depicts the edit distance between each sequence cluster.

Figure 9:
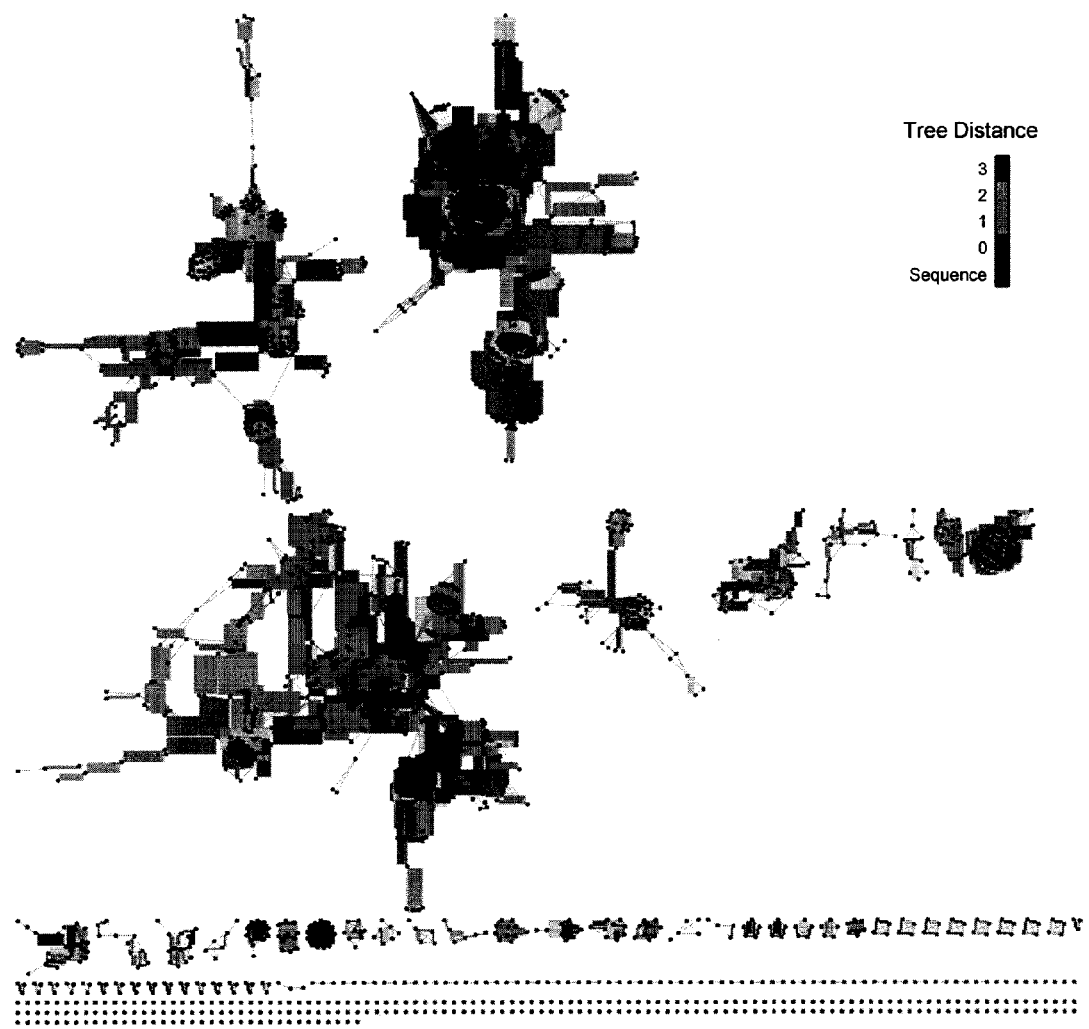

FIG. 9. Unique sequences interconnected by a tree distance=3. Structures of unique sequences (black nodes) interconnect by edges of tree distances 0-3 (0=blue, 1=cyan, 2=green, 3=red). Separate groups of unique sequences with no interconnections are more than 3 tree distances apart.

Figure 10:
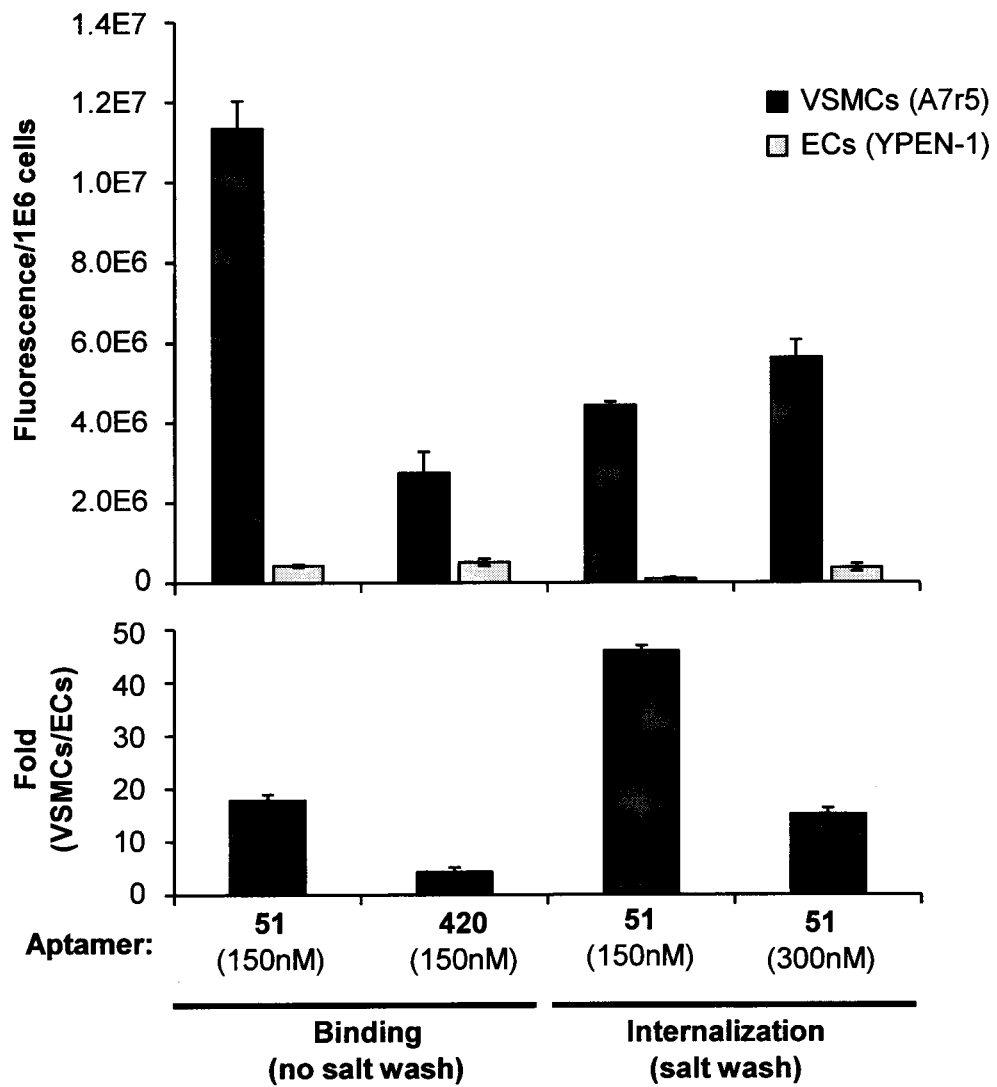

FIG. 10. Binding and internalization of Fam-GTP labeled aptamers. RNA aptamers #51 and #420 were labeled during in vitro transcription with a Fam-GTP. Binding of aptamers #51 and #420 was determined by fluorescence after several PBS washes without high salt. Internalization of aptamer #51 was determined at 150 nM and 300 nM by fluorescence following several PBS washes that included a high salt wash.

Figure 11:
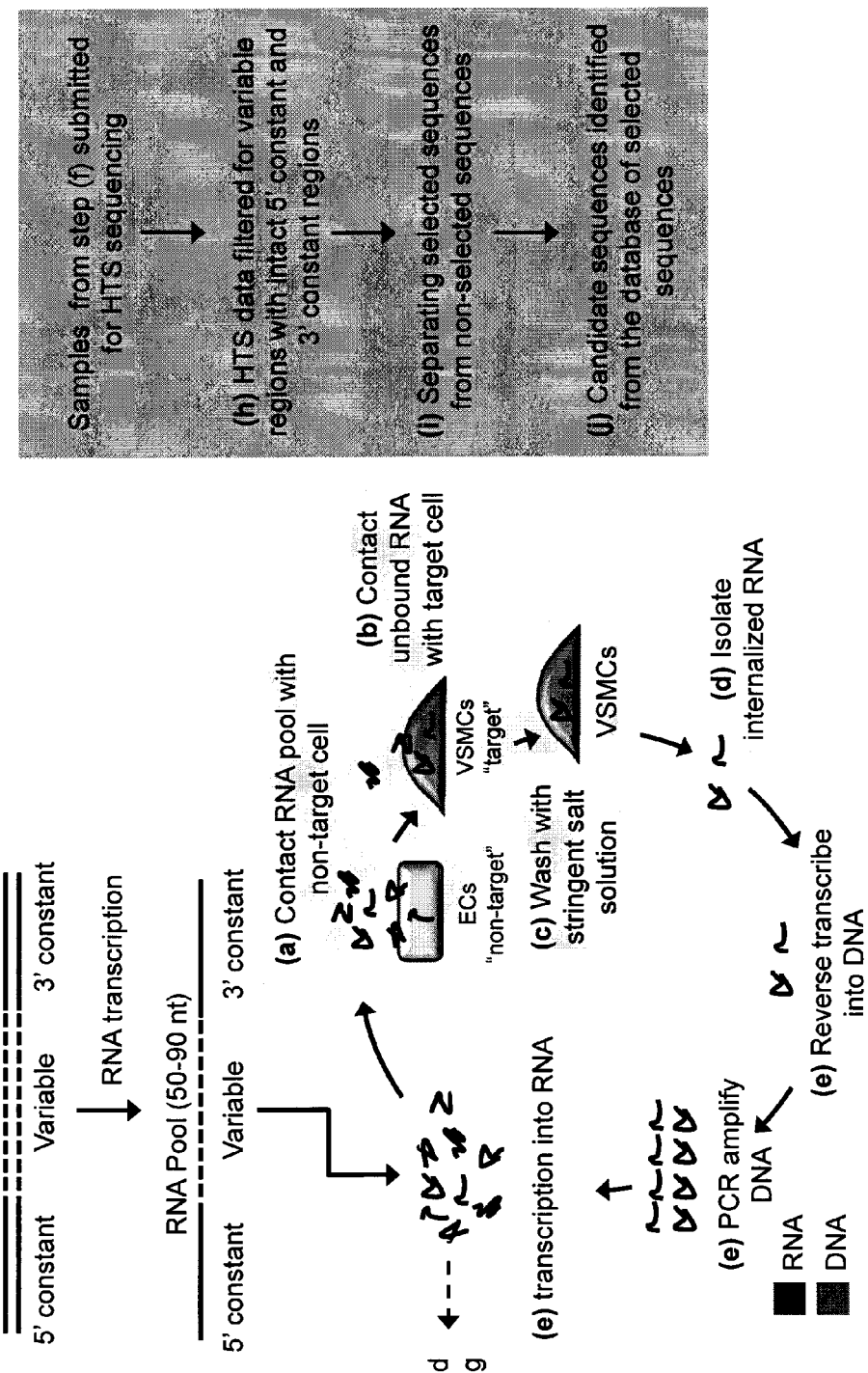

FIG. 11. Method of Identification of Novel Aptamers.

Figures 12, 13, 14, 15, 16, 17, 18, 19:
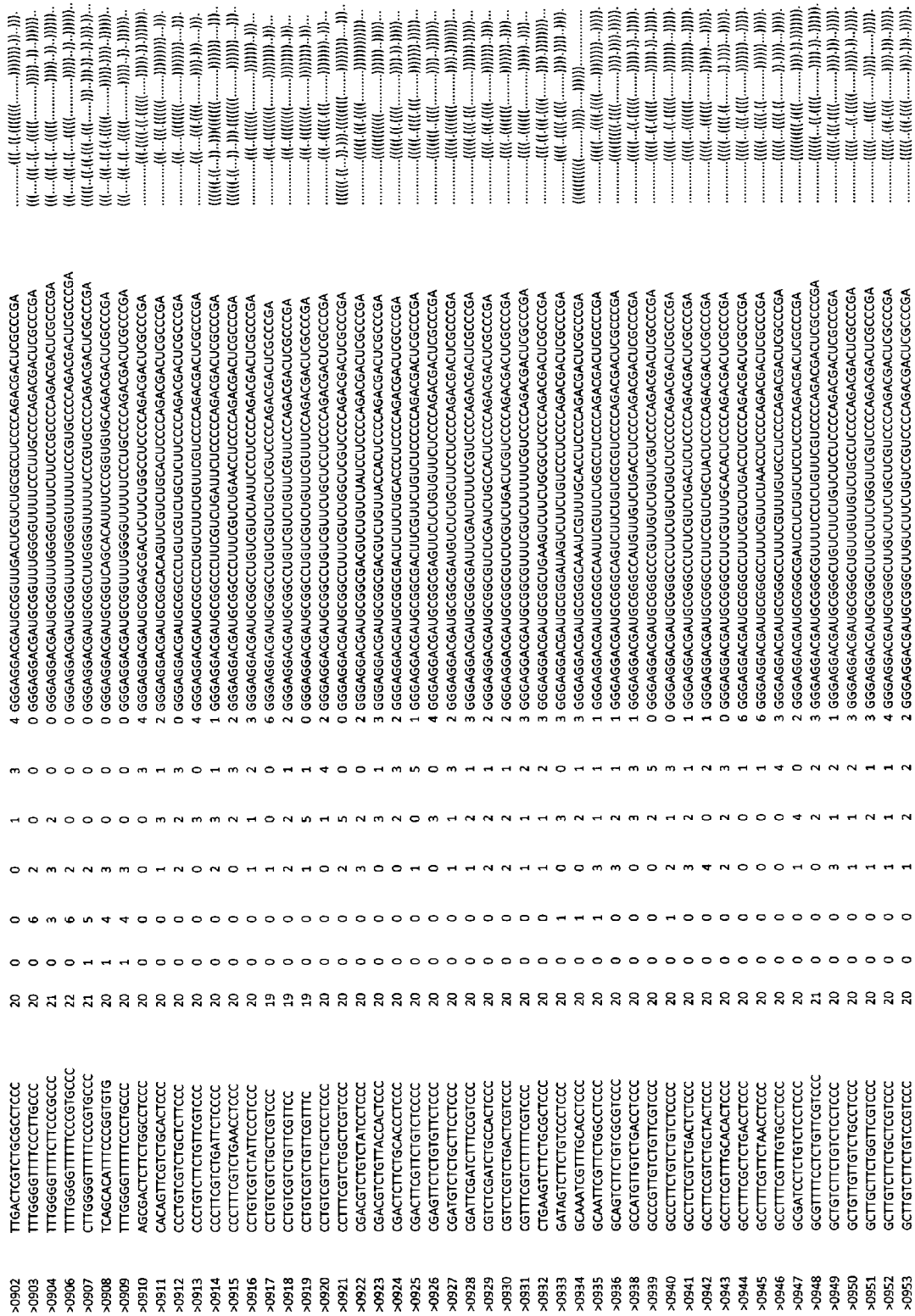

FIG. 12. Excel/CVS Data File 1: Excel data file includes all unique selected sequences. Column label identifiers:
(#)=identification number
(Representatives)=selected RNA aptamer representatives (X)
(HTS read variable region)=variable region identified by HTS (SEQ ID NOS 10-2321, respectively, in order of appearance)
(Length)=nucleotide length of the variable region
(1)=number of reads in round 1
(3)=number of reads in round 3
(5)=number of reads in round 5
(6)=number of reads in round 6
(7)=number of reads in round 7
(8)=number of reads in round 8
(RNA)=RNA aptamer sequence (variable region with 5' and 3' constant regions) (SEQ ID NOS 2322-4633, respectively, in order of appearance)
(Structure)=predicted secondary structure of the RNA aptamer sequence.

FIG. 13: Ex vivo VSMC aptamer internalization. Rat aortic segments with either denuded or intact endothelium were exposed to A) enriched (Round 8), an un-enriched round (Round 1) of aptamers or B) our previously identified VSMC-specific aptamers. Non-internalized aptamer was removed by high salt wash and internalized aptamer, recovered by TRIzol extraction and measured by RT-qPCR.(* $p<0.05$).

FIG. 14: Perfused vessel ex vivo VSMC aptamer internalization. A) Rat arterial vessel segments (carotid/femoral) with either denuded or intact endothelium were perfused with B) enriched (Round 8) aptamers. Non-internalized aptamer was removed by high salt wash and internalized aptamer, recovered by TRIzol extraction and measured by RT-qPCR. (* $p<0.05$)

FIG. 15: Internalization of VSMC aptamers in an in vivo model of arterial injury. A) Schematic of in vivo aptamer internalization assay. The illiac and femoral arteries were clamped and epigastric ligated. The deep femoral was cannulated to allow access to the illiac and fermoral arteries for endothelium denuding by balloon angioplasty and subsequent exposure of aptamers. Denuded endothelium or intact arteries were perfused with 150 nM non-internalizing control aptamer or VSMC-specific aptamers (01, 14, and 51) for 30 min. Following stringent washes to remove surface-bound aptamers, arteries were isolated and aptamers recovered and quantitated by RT-qPCR. B) Raw data of recovered internalized aptamers. Endothelium denuded and endothelium intact arteries were exposed to either a non-internalizing control aptamer (Control), aptamers 01, aptamer 14, or aptamer 51. Non-internalized aptamer was removed by high salt wash and internalized aptamer, recovered by TRIzol extraction and measured by RT-qPCR. (* $p<<0.05$) C) Internalization into endothelium denuded relative to intact vessels.

FIG. 16: Ex vivo aptamer internalization into human pulmonary artery segments. Segments of human pulmonary artery were denuded and exposed to control aptamer or A) aptamer 01, B) aptamer 14, C) aptamer 51. Non-internalized aptamer was removed by high salt wash and internalized aptamer, recovered by TRIzol extraction and measured by RT-qPCR. (**$p<<0.05$; *$p<0.5$)

FIG. 17: Aptamer antagonism of PDGF-BB dependent VSMC migration but not EC migration. PDGF-BB (10 ng/mL) dependent migration was measured for A) VSMCs and B) ECs by transwell migration assay in the presence of aptamers. (* $p<0.05$).

FIG. 18: Aptamer antagonism of TNF-α and thrombin dependent VSMC migration. A) TNF-α and B) thrombin dependent VSMC migration was measured by transwell migration assay in the presence of aptamers. (* $p<0.05$)

FIG. 19: Aptamer 51 siRNA chimera internalization. Aptamer 51 aptamer-siRNA chimeras (#1 and #2) internalized as well as aptamer 51 alone. Non-internalized aptamer or aptamer chimera was removed by high salt wash and internalized aptamer or aptamer chimera, recovered by TRIzol extraction and measured by RT-qPCR.

Figures 12, 13, 14, 15, 16, 17, 18, 19, 20, 21, 22, 23, 24, 25, 26, 27, 28, 29, 30, 31, 32, 33, 34, 35, 36, 37, 38:
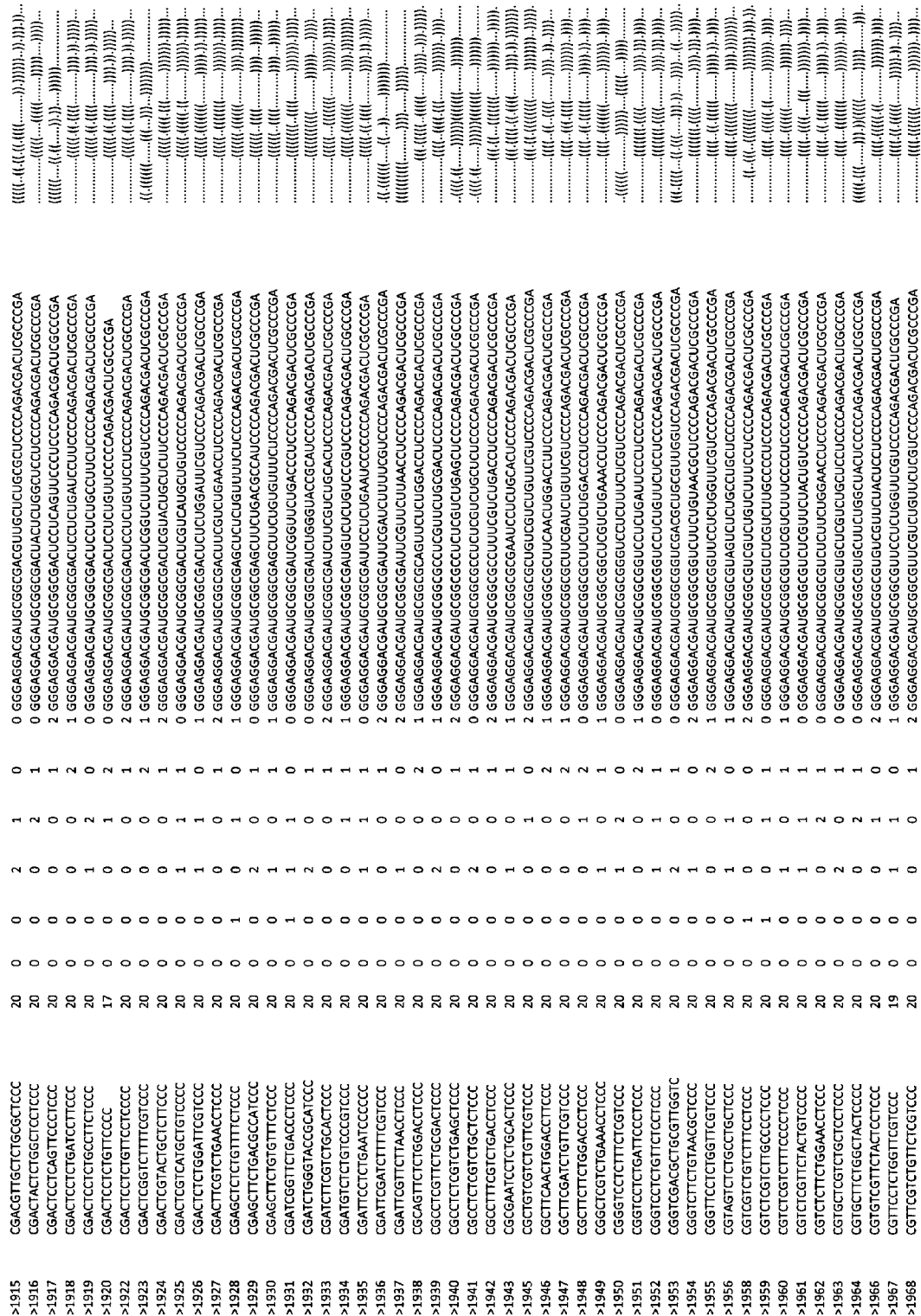
Figures 12, 13, 14, 15, 16, 17, 18, 19, 20, 21, 22, 23, 24, 25, 26, 27, 28, 29, 30, 31, 32, 33, 34, 35, 36, 37, 38, 39, 40:
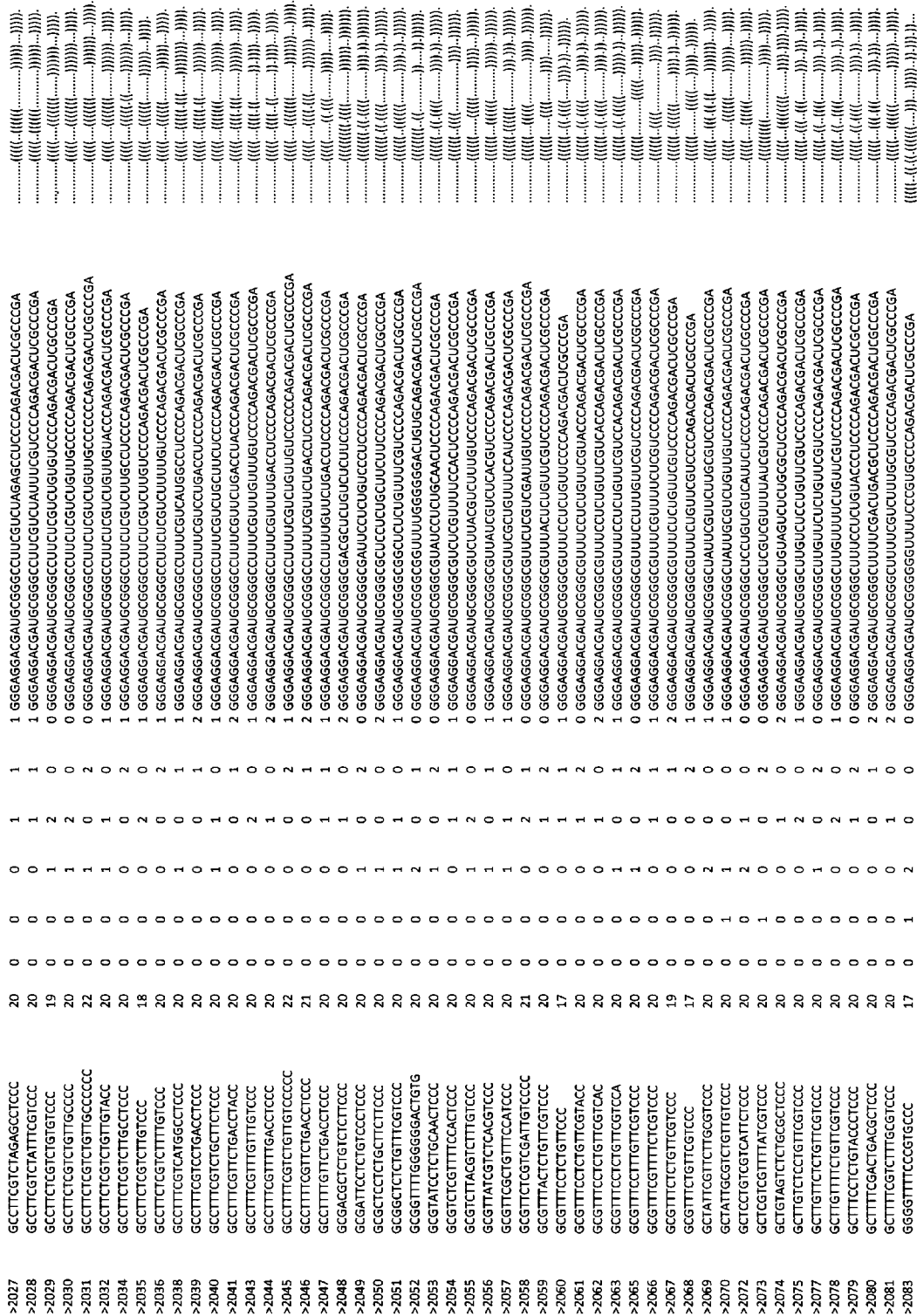
Figure 13:
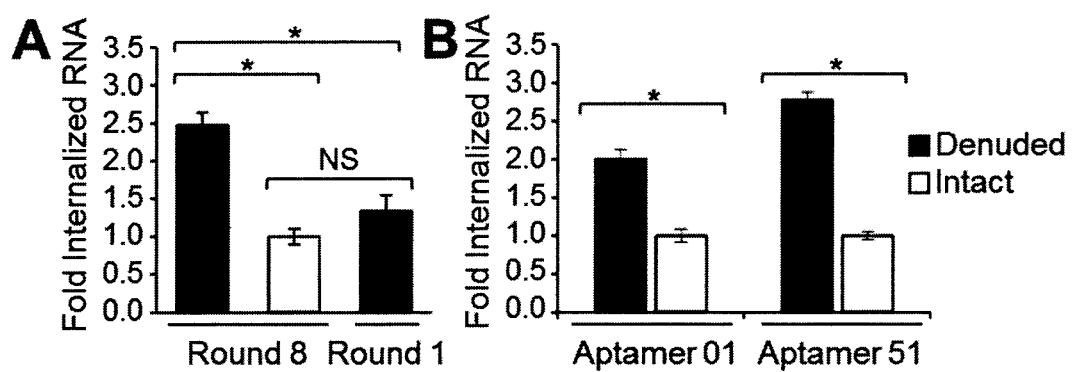
Figure 14:
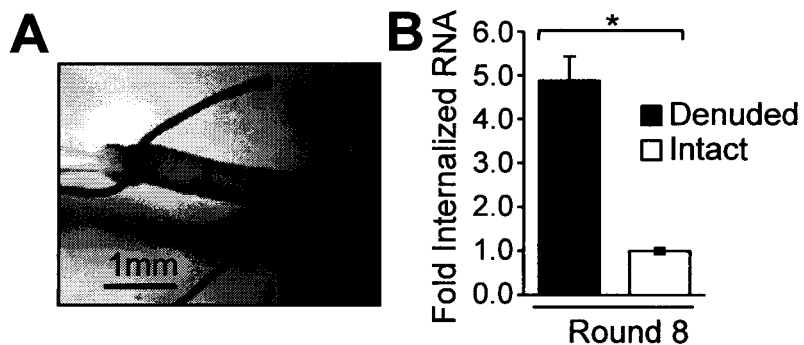
Figure 15:
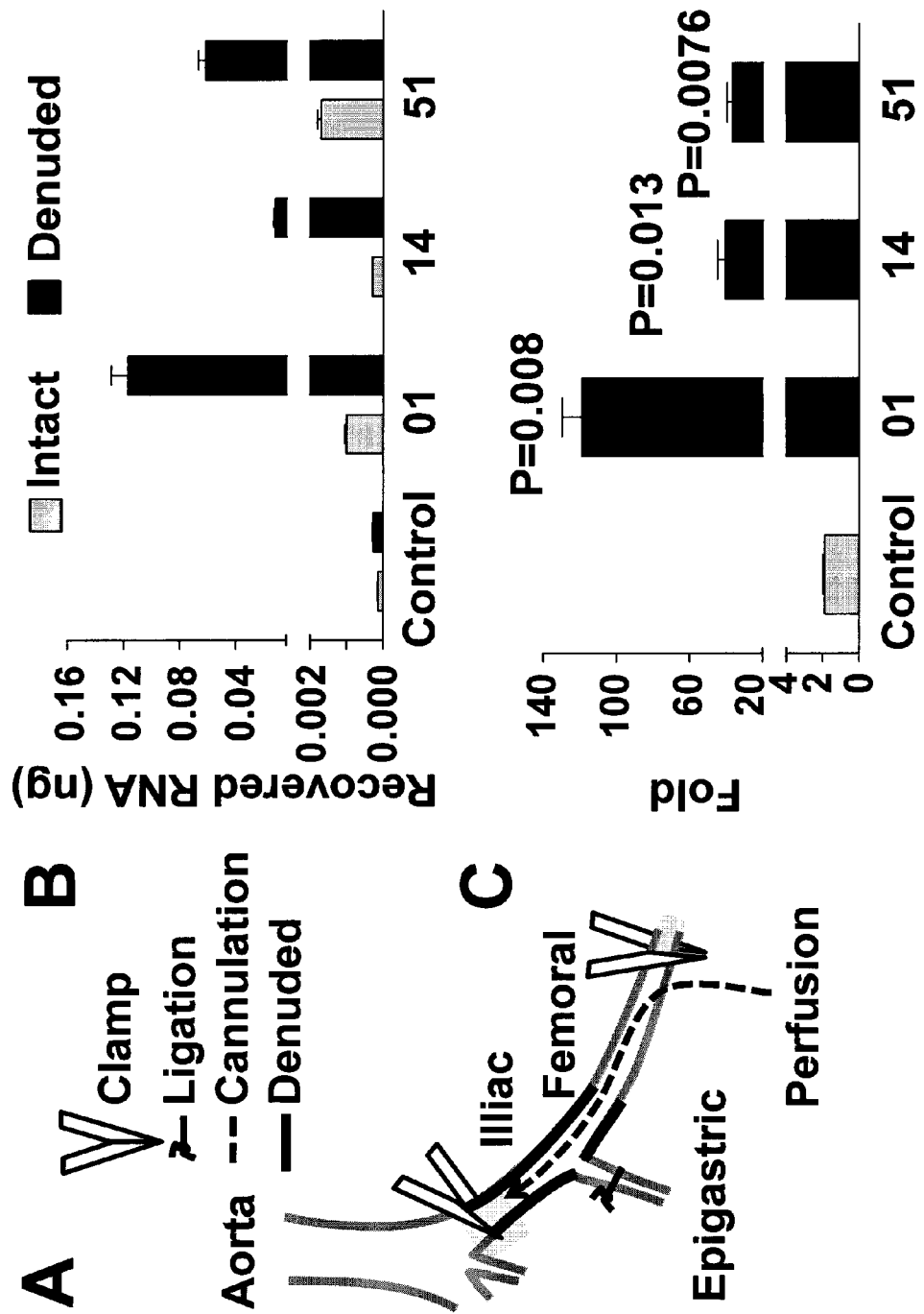
Figure 16:
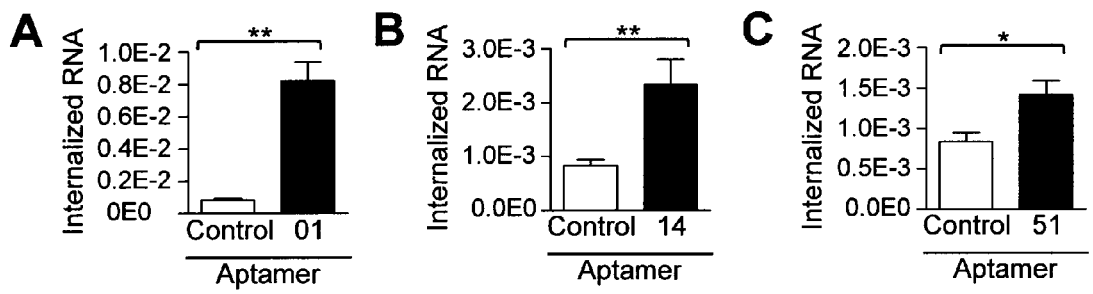
Figure 17:
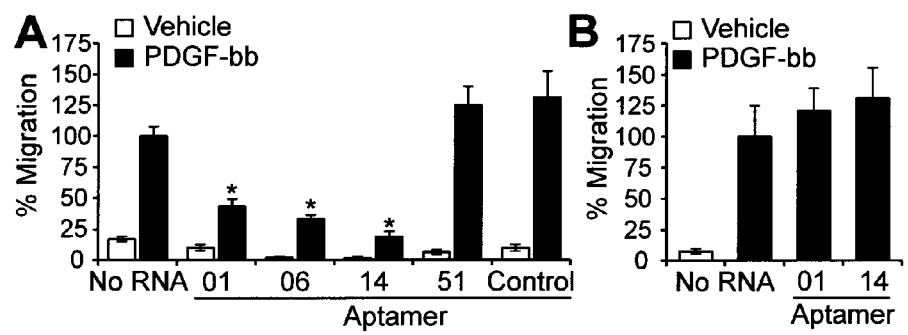
Figure 18:
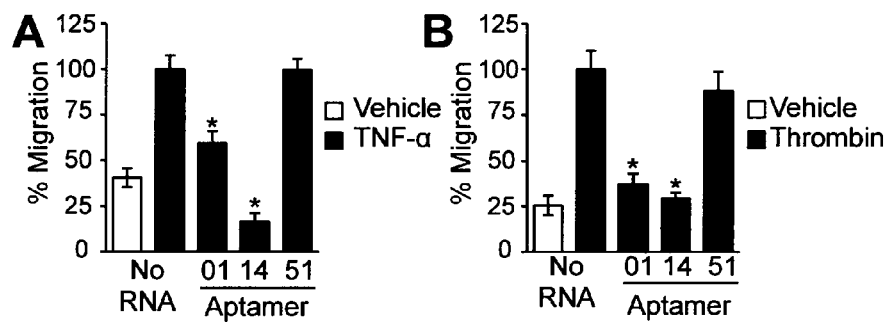
Figure 19:
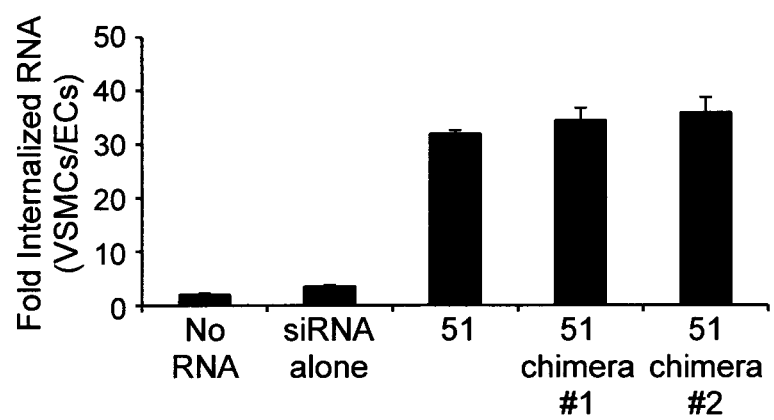
Figure 20:
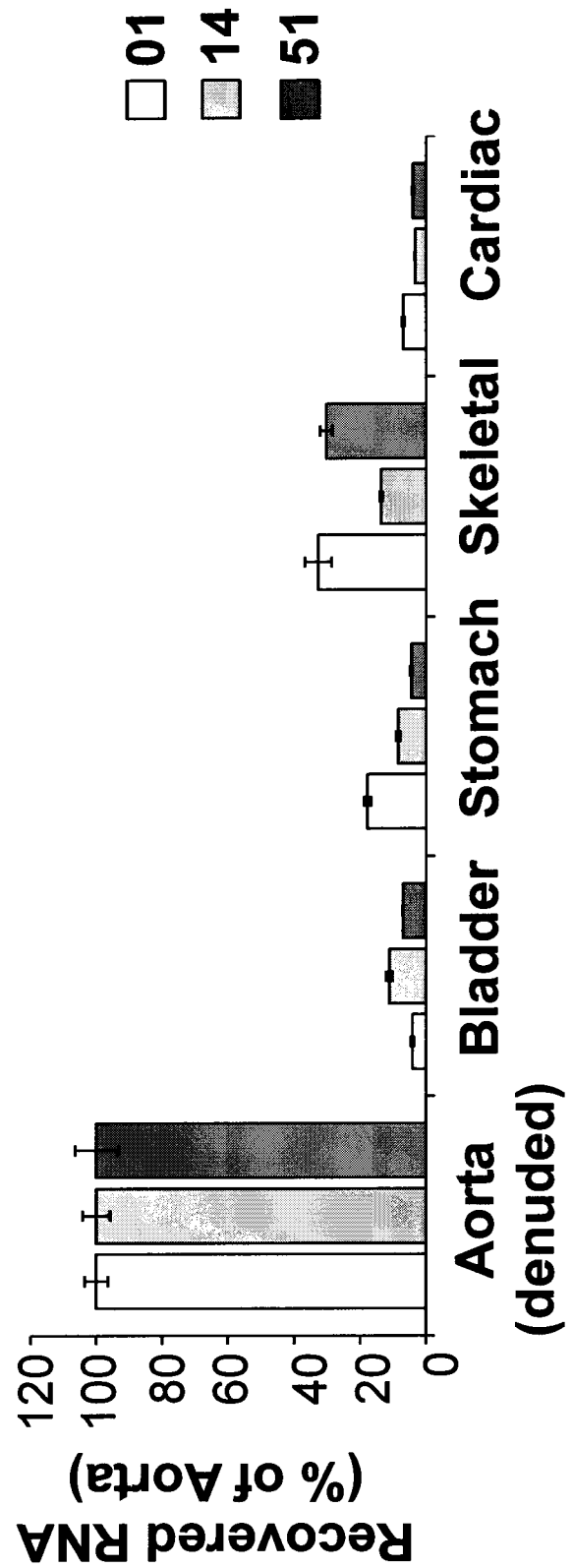
Figure 21:
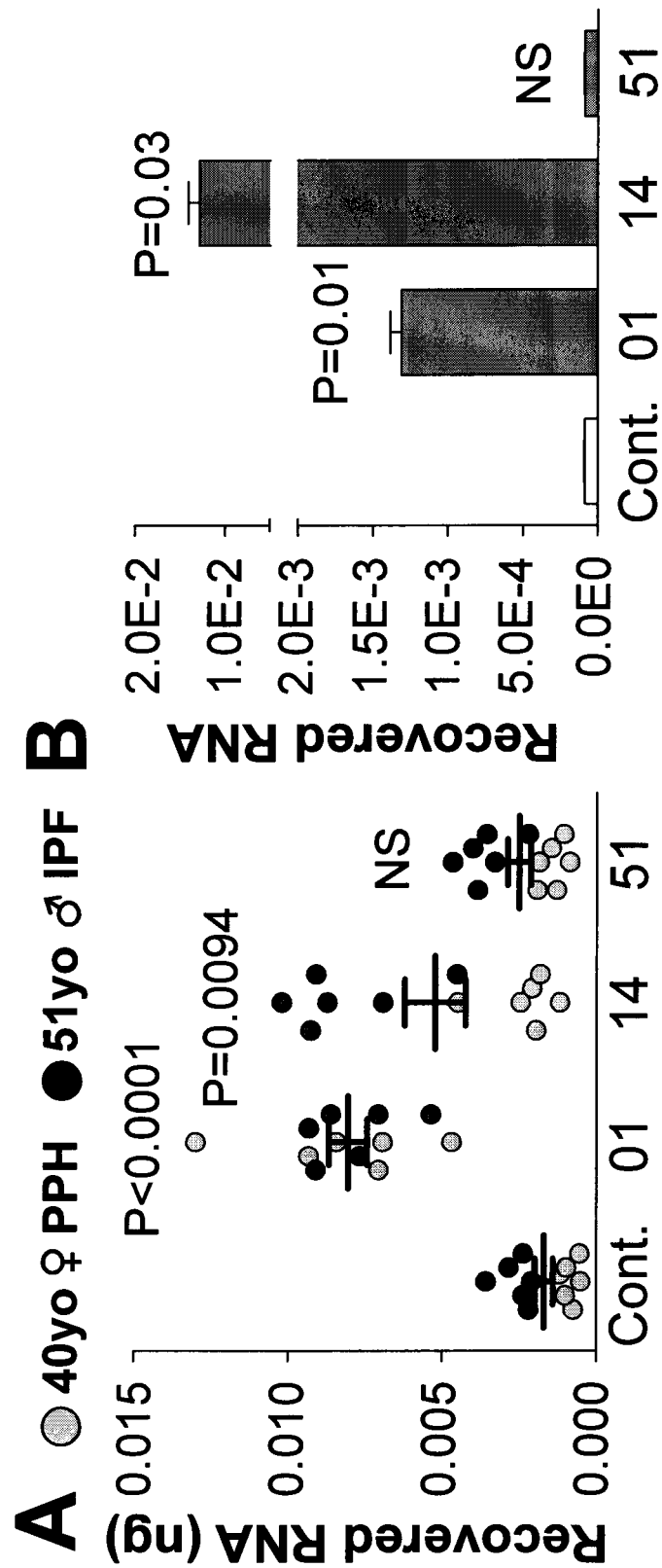

FIG. 20: Aptamers are specific for vascular smooth muscle over muscle types. Aptamers (150 nM) were incubated with tissue segments ex vivo for 30 min and recovered RNA measured by RT-qPCR. Data were normalized to tissue mass and expressed relative to denuded aorta.

FIG. 21: Cross-reactivity with human arterial segments and VSMCs. Amount of recovered RNA by RT-qPCR after incubation of aptamers (150 nM) for 30 min on A) segments of human pulmonary artery (PPH=primary pulmonary hypertension; IPF=Idiopathic pulmonary fibrosis); or B) $1.25\times10^5$ cultured primary human aortic VSMCs (ATCC # PCS-100-012).

DETAILED DESCRIPTION OF THE INVENTION

Vascular revascularization by stenting is associated with restenosis due to proliferation of vascular smooth muscle cells (VSMCs) and intimal hyperplasia. Although the use of cell cycle inhibitors in drug eluting stents (DES) has reduced the rate of in-stent restenosis, this approach also inhibits re-endothelialization, thereby requiring prolonged antithrombotic regimens to prevent stent thrombosis. Delivery of nucleic acid aptamers by DES is a new approach due to their high specific binding affinity and potential for modification by medicinal chemistry. We have identified RNA aptamers that (1) internalize into VSMCs and/or (2) specifically inhibit VSMC activation. Using an in vivo compatible RNA aptamer library, VSMC-specific aptamers were selected using a cell-internalization SELEX (systematic evolution of ligands by exponential enrichment) process with iterative rounds of positive selection using VSMCs and ECs. Specificity of these aptamers was confirmed by ex vivo studies that demonstrated preferential internalization into denuded, but not endothelium-intact, artic segments. In addition, several of the VSMC-targeting aptamers exhibited differential effectiveness in inhibiting VSMC migration as measured by Boyden chamber assays. In delivery studies, we next engineered aptamer-siRNA chimeras using siRNAs targeting Nx1 NADPH oxidase, which has been implicated in intimal hyperplasia. These VSMC-targeting aptamer-siRNA chimeras retain specificity for VSMCs and are being evaluated for efficacy in reducing intimal formation in a murine model of vascular injury. Thus, we developed novel VSMC-targeting aptamers that may serve as a platform technology to selective deliver therapeutics to VSMCs over ECs. The aptamers that inhibited cell migration present an opportunity for dual-action VSMC-targeted therapeutic agents.

The present technology is a series of RNA constructs that have been created to specifically inhibit the migration and proliferation of VSMCs. Several constructs have been created which likely bind to a diverse set of cell surface receptors on VSMC (with 20-fold greater specificity than binding to endothelial cells). Initial studies have demonstrated that these aptamers not only bind to, but also inhibit the migration of the VSMCs when used alone. However, the targeting aptamers can also be linked to RNAi molecules that target the production of proteins necessary for intimal hyperplastic growth, such as Nox1 NADPH oxidase. These are VSMC-targeting aptamers, some of which may have growth retarding effects themselves that can be paired with RNAi to inhibit the expression of any target protein within VSMCs. In certain embodiments, the constructs are chemically modified (2'-fluoropyridines) RNA constructs making them nuclease resistant. See WO 2010/019446, which is incorporated by reference in its entirety.

Aptamer Portion

Aptamers are single stranded oligonucleotides that can naturally fold into different 3-dimensional structures, which have the capability of binding specifically to biosurfaces, a target compound or a moiety. The term "conformational change" refers to the process by which a nucleic acid, such as an aptamer, adopts a different secondary or tertiary structure. The term "fold" may be substituted for conformational change.

Aptamers have advantages over more traditional affinity molecules such as antibodies in that they are very stable, can be easily synthesized, and can be chemically manipulated with relative ease. Aptamer synthesis is potentially far cheaper and reproducible than antibody-based diagnostic tests. Aptamers are produced by solid phase chemical synthesis, an accurate and reproducible process with consistency among production batches. An aptamer can be produced in large quantities by polymerase chain reaction (PCR) and once the sequence is known, can be assembled from individual naturally occurring nucleotides and/or synthetic nucleotides. Aptamers are stable to long-term storage at room temperature, and, if denatured, aptamers can easily be renatured, a feature not shared by antibodies. Furthermore, aptamers have the potential to measure concentrations of ligand in orders of magnitude lower (parts per trillion or even quadrillion) than those antibody-based diagnostic tests. These characteristics of aptamers make them attractive for diagnostic applications.

Aptamers are typically oligonucleotides that may be single stranded oligodeoxynucleotides, oligoribonucleotides, or modified oligodeoxynucleotide or oligoribonucleotides. The term "modified" encompasses nucleotides with a covalently modified base and/or sugar. For example, modified nucleotides include nucleotides having sugars which are covalently attached to low molecular weight organic groups other than a hydroxyl group at the 3' position and other than a phosphate group at the 5' position. Thus modified nucleotides may also include 2' substituted sugars such as 2'-O-methyl-; 2-O-alkyl; 2-O-allyl; 2'-S-alkyl; 2'-S-allyl; 2'-fluoro-; 2'-halo or 2-azido-ribose, carbocyclic sugar analogues a-anomeric sugars; epimeric sugars such as arabinose, xyloses or lyxoses, pyranose sugars, furanose sugars, and sedoheptulose.

Modified nucleotides are known in the art and include, by example and not by way of limitation, alkylated purines and/or pyrimidines; acylated purines and/or pyrimidines; or other heterocycles. These classes of pyrimidines and purines are known in the art and include, pseudoisocytosine; N4,N4-ethanocytosine; 8-hydroxy-N-6-methyladenine; 4-acetylcytosine, 5-(carboxyhydroxylmethyl) uracil; 5-fluorouracil; 5-bromouracil; 5-carboxymethylaminomethyl-2-thiouracil; 5-carboxymethylaminomethyl uracil; dihydrouracil; inosine; N6-isopentyl-adenine; 1-methyladenine; 1-methylpseudouracil; 1-methylguanine; 2,2-dimethylguanine; 2-methyladenine; 2-methylguanine; 3-methylcytosine; 5-methylcytosine; N6-methyladenine; 7-methylguanine; 5-methylaminomethyl uracil; 5-methoxy amino methyl-2-thiouracil; β-D-mannosylqueosine; 5-methoxycarbonylmethyluracil; 5-methoxyuracil; 2-methylthio-N-6-isopentenyladenine; uracil-5-oxyacetic acid methyl ester; psueouracil; 2-thiocytosine; 5-methyl-2 thiouracil, 2-thiouracil; 4-thiouracil; 5-methyluracil; N-uracil-5-oxyacetic acid methylester; uracil 5-oxyacetic acid; queosine; 2-thiocytosine; 5-propyluracil; 5-propylcytosine; 5-ethyluracil; 5-ethylcytosine; 5-butyluracil; 5-pentyluracil; 5-pentylcytosine; and 2,6,-diaminopurine; methylpsuedouracil; 1-methylguanine; 1-methylcytosine.

The aptamers of the invention are synthesized using conventional phosphodiester linked nucleotides and synthesized using standard solid or solution phase synthesis techniques which are known in the art. Linkages between nucleotides may use alternative linking molecules. For example, linking groups of the formula P(O)S, (thioate); P(S)S, (dithioate); P(O)NR'2; P(O)R'; P(O)OR6; CO; or CONR'2 wherein R is H (or a salt) or alkyl (1-12C) and R6 is alkyl (1-9C) is joined to adjacent nucleotides through —O— or —S—.

In certain embodiments of the present invention, the aptamer portion is specific for vascular smooth muscle cells (VSCMs). In certain embodiments, the aptamers of the present invention are taken up by the VSCMs. In certain embodiments, additional modifications are made to the aptamer portion. Additional modifications to the aptamer portion include 2'O-methyl modification of the pyrimidines. In other embodiments, all of the nucleotides in the aptamer are 2'O-methyl modified. Alternatively, the pyrimidines, or all the nucleotides, may be modified with 2' fluoros (both pyrimidines and purines). Additional modifications to the nucleotides in the aptamer include large molecular weight conjugates like pegylation, lipid-based modifications (e.g., cholesterol) or nanoparticles (e.g., PEI or chitosan) to improve the pharmacokinetic/dynamic profile of the chimera.

Small Molecule Portion

The aptamers of the present invention can be operably linked to one or more small molecule entities. In certain embodiments, the entity is a fluorescent tag, affinity tag, a protein, a solid substrate, a cell surface, or a cellular component. In certain embodiments, the cellular component is a cell wall or cell membrane. In certain embodiments, the solid substrate is a component of silica, cellulose, cellulose acetate, nitrocellulose, nylon, polyester, polyethersulfone, polyolefin, or polyvinylidene fluoride, or combinations thereof. In certain embodiments, the solid substrate is a stent or other medical device, filter, magnetic bead, metal oxide, latex particle, microtiter plates, polystyrene bead, or CD-ROM.

In certain embodiments, the aptamer is linked to the entity by means of a linker. In certain embodiments, the linker is a binding pair. In certain embodiments, the "binding pair" refers to two molecules which interact with each other through any of a variety of molecular forces including, for example, ionic, covalent, hydrophobic, van der Waals, and hydrogen bonding, so that the pair have the property of binding specifically to each other. Specific binding means that the binding pair members exhibit binding to each other under conditions where they do not bind to another molecule. Examples of binding pairs are biotin-avidin, hormone-receptor, receptor-ligand, enzyme-substrate, IgG-protein A, antigen-antibody, and the like. In certain embodiments, a first member of the binding pair comprises avidin or streptavidin and a second member of the binding pair comprises biotin. In certain embodiments, the aptamer is linked to the entity by means of a covalent bond.

The entity, for example, may additionally or alternatively, be a detection means. A number of "molecular beacons" (such as fluorescence compounds) can be attached to aptamers to provide a means for signaling the presence of and quantifying a target chemical or biological agent. Other exemplary detection labels that could be attached to the aptamers include biotin, any fluorescent dye or tracer, amine modification, horseradish peroxidase, alkaline phosphatase, etc.

In certain embodiments, the aptamer is operably linked to a detection means and to a solid substrate. For example, the aptamer may be linked to a fluorescent dye and to a magnetic bead.

The small molecule portion of the ligand can be siRNA sequences, miRNAs, small molecule inhibitors, chelators for housing radionuclides (for diagnostic/imaging applications as well as development of targeted radiotherapies, see, e.g., Rockey et al., Synthesis and radiolabeling of chelator-RNA aptamer bioconjugates with copper-64 for targeted molecular imaging, *Bioorganic & Medicinal Chemistry*, 19: 4080-4090 (2011)), nanoparticles containing all of the above plus DNA vectors and/or mRNA sequences, depending on the use of the ligand as a diagnostic agent or as a therapeutic agent. In certain embodiments, the small molecule is an siRNA specific for Nox1 NADPH oxidase. In certain embodiments, the small molecule is a molecule capable of modulating cell activity, including but not limited to biologic and pharmacologic inhibitors/agonists, siRNA, or miRNA. In certain embodiments, the small molecules are biologic or pharmacoligic agents that can alter smooth muscle cell migration and/or proliferation and/or phenotypic modulation and/or changes in gene expression.

Linking Molecules

Chemistries that can be used to link molecules to the aptamer are known in the art, such as disulfide linkages, amino linkages, covalent linkages, etc. Additional linkages and modifications can be found on the world-wide-web at trilinkbiotech.com/products/oligo/oligo_modifications.asp.

Solid Substrates

In certain embodiments, the aptamer or conjugate is in contact with a solid substrate. In certain embodiments the solid substrate is a component of silica, cellulose, cellulose acetate, nitrocellulose, nylon, polyester, polyethersulfone, polyolefin, or polyvinylidene fluoride, or combinations thereof. In certain embodiments, the solid substrate is a filter, magnetic bead, metal oxide, latex particle, microtiter plates, polystyrene bead, or medical device.

The aptamer or conjugate may be placed onto various solid substrates, such as a stent, catheter (e.g., a peripheral intravenous catheter, a central venous catheter, or a urinary catheter, or a catheter hub, or a catheter port) or a non-degradable implant (e.g., such as a joint implant (knee, hip, ankle, etc.), a bone pin, or a prosthetic heart valve). In particular, the coating may be placed on vascular stents that are typically used for long periods of time.

Methods of Identifying and Purifying Aptamers

Certain embodiments of the present invention provide a method of isolating cell-internalized RNA (FIG. 11). In certain embodiments, the method comprises:

(a) contacting an initial RNA pool, consisting of RNA sequences derived from a duplex DNA library using in vitro transcription, with a non-target cell to generate unbound RNA and bound RNA and remove the bound RNA;

(b) contacting the unbound RNA with a target cell to generate cell-bound RNA, cell-unbound RNA, and cell-internalized RNA;

(c) wash the target cell with a stringent salt solution; and (d) isolate the cell-internalized RNA, wherein RNA in the RNA pool is not more than 90 nucleotides in length. In certain embodiments, the RNA is about 40-60 nucleotides in length, such as 45-50 nucleotides in length. The RNA pool can vary in length (e.g., 50-90 nt). The RNAs in the pool contain a central region of unique sequence flanked by constant sequence regions. In certain embodiments, the central region of unique sequence is about 15-25 nucleotides (e.g., 20 nt), and the constant sequence regions are about 10-20 nucleotides in length (e.g., 15 or 16 nt). As used herein the term "target cell" is a cell into which one desires to have an aptamer selectively enter. As used herein "selectively" means that the aptamer is internalized at a higher rate than a control, non-target cell. As used herein the term "bound" means that the aptamer attaches to the surface of the cell, e.g., binds to a cell receptor or other feature on the surface of the cell and is no longer free-floating in the media or solution. As used herein, the term "unbound RNA" refers to RNA that remains in the solution/media and not bound to the cells. As used herein the term "cell-internalized RNA" means RNA that can access the interior of the cell either by binding to a cell surface protein or directly traversing the cell membrane. In certain embodiments, the stringent salt solution comprises 0.5M NaCl in Dulbecco's Phosphate Buffered Saline (DPBS).

In certain embodiments, the contacting in step (a) is performed for 5 to 30 minutes, such as for 15 to 20 minutes. In certain embodiments, the contacting in step (b) is performed for 60 to 120 minutes, such as 75 to 100 minutes.

In certain embodiments, the method further comprises (e) reverse transcribing and PCR amplifying the cell-internalized RNA to generate a secondary RNA pool.

In certain embodiments, the method further comprises (f) obtaining a sample from the secondary RNA pool, (g) performing high throughput sequencing (HTS) to obtain raw reads of unique sequences and non-unique sequences, (h) filtering the raw reads based on RNA library constant region sequences (5' constant as HTS DNA sequence=5'-GGGAGGACGATGCGG-3' (SEQ ID NO: 1); 3' constant as HTS DNA sequence=5'-CAGACGACTCGCCCGA-3' (SEQ ID NO: 2)) to obtain filtered reads, and (i) determining which filtered reads are selected sequences (sequences enriched by the SELEX process) and which are non-selected sequences (background sequences indicative of the unenriched starting RNA pool).

(j) a database of selected sequences is analyzed for candidate sequences by calculating the fold enrichment of HTS reads between two rounds of selection, such as the fold enrichment of round 3 to round 8.

In certain embodiments, the method further comprises repeating steps (a)-(i) one to eight times.

In certain embodiments, steps (a)-(f) are repeated until complexity of the RNA in the secondary pool has reduced by 50% as compared to the initial pool at which point samples collect at (f) undergo steps (g)-(h).

In certain embodiments, the present invention provides a method of identifying a true-selected sequence by obtaining the number of times a unique sequence appears in each round of selection (cluster size), wherein true-selected sequence is a unique sequence that appears in at least three rounds of selection.

In certain embodiments, the present invention provides a method of identifying a true-selected sequence by comparing the unique sequences of different rounds of selection, and identifying a unique sequence present in at least two rounds of selection. As used herein a "round of selection" is a process involving steps (a)-(i). In certain embodiments, the method further comprising obtaining the number of times a unique sequence appeared in each round of selection. In certain embodiments, the method further comprises determining the edit distance of the unique sequences as compared to the other sequences in the round of selection. Edit distance is defined as the number of changes (substitution/insertion/deletion) necessary for two sequences to become identical. For example, closely-related sequences have a low edit distance, while unrelated or loosely-related sequences are denoted by a high edit distance.

In certain embodiments, the method further comprises determining the tree distance of the unique sequences as compared to the other sequences in the round of selection. "Tree distance" describes the relatedness of two structures by calculating the dissimilarity between two structures. Analogous with edit distance, closely-related structures have a low tree distance, while unrelated or loosely-related structures are denoted by a large tree distance. In certain embodiments, the present invention provides an aptamer having a true-selected sequence present in at least two rounds of selection, having a cluster size of at least 3, having an edit distance of 1, and having a tree distance of less than 3.

Detection Methods

The present invention provides methods for identifying regions of the vasculature that have had endothelial damage or de-endothelialization or impaired re-endothelialization. The aptamers of the present invention may also be used to identify regions of plaque rupture or instability, or of smooth muscle cell activation. in a sample or in vivo. In certain embodiments, the aptamers are modified to include fluorescent dyes or tracers to facilitate the identification of restenosed vessels. For example, one can contact a sample with an aptamer as described herein or the composition as described herein to form bound VSMC or VSMC that contain internalized aptamers, and detecting the presence or the quantity of VSMC aptamers. Alternatively, aptamers or compositions can be administered in vivo to a patient (e.g. injected in situ into a tumor). In certain embodiments, the bound VSMC aptamer is detected by means of PCR, nuclear magnetic resonance, fluorescent capillary electrophoresis, lateral flow devices, colorimetry, chemiluminescence, fluorescence, southsester blots, microarrays, or ELISA.

Amplification Methods

In one embodiment of the present invention, the method involves the amplification of selected RNAs. "Amplifying"

utilizes methods such as the polymerase chain reaction (PCR), ligation amplification (or ligase chain reaction, LCR), strand displacement amplification, nucleic acid sequence-based amplification, and amplification methods based on the use of Q-beta replicase. These methods are well known and widely practiced in the art. Reagents and hardware for conducting PCR are commercially available. In one embodiment of the present invention, at least one type of aptamer is immobilized on a solid surface.

According to the methods of the present invention, the amplification may be carried out by any means known to the art. Examples of suitable amplification techniques include, but are not limited to, polymerase chain reaction (including, for RNA amplification, reverse-transcriptase polymerase chain reaction), ligase chain reaction, strand displacement amplification, transcription-based amplification, self-sustained sequence replication (or "3SR"), the QR replicase system, nucleic acid sequence-based amplification (or "NASBA"), the repair chain reaction (or "RCR"), and boomerang DNA amplification (or "BDA").

The bases incorporated into the amplification product may be natural or modified bases (modified before or after amplification), and the bases may be selected to optimize subsequent electrochemical detection steps.

Polymerase chain reaction (PCR) may be carried out in accordance with known techniques. See, e.g., U.S. Pat. Nos. 4,683,195; 4,683,202; 4,800,159; and 4,965,188. In general, PCR involves, first, treating a nucleic acid sample (e.g., in the presence of a heat stable DNA polymerase) with one oligonucleotide primer for each strand of the specific sequence to be detected under hybridizing conditions so that an extension product of each primer is synthesized that is complementary to each nucleic acid strand, with the primers sufficiently complementary to each strand of the specific sequence to hybridize therewith so that the extension product synthesized from each primer, when it is separated from its complement, can serve as a template for synthesis of the extension product of the other primer, and then treating the sample under denaturing conditions to separate the primer extension products from their templates if the sequence or sequences to be detected are present. These steps are cyclically repeated until the desired degree of amplification is obtained. Detection of the amplified sequence may be carried out by adding to the reaction product an oligonucleotide probe capable of hybridizing to the reaction product (e.g., an oligonucleotide probe of the present invention), the probe carrying a detectable label, and then detecting the label in accordance with known techniques. Where the nucleic acid to be amplified is RNA, amplification may be carried out by initial conversion to DNA by reverse transcriptase in accordance with known techniques.

Strand displacement amplification (SDA) may be carried out in accordance with known techniques. For example, SDA may be carried out with a single amplification primer or a pair of amplification primers, with exponential amplification being achieved with the latter. In general, SDA amplification primers comprise, in the 5' to 3' direction, a flanking sequence (the DNA sequence of which is noncritical), a restriction site for the restriction enzyme employed in the reaction, and an oligonucleotide sequence (e.g., an oligonucleotide probe of the present invention) that hybridizes to the target sequence to be amplified and/or detected. The flanking sequence, which serves to facilitate binding of the restriction enzyme to the recognition site and provides a DNA polymerase priming site after the restriction site has been nicked, is about 15 to 20 nucleotides in length in one embodiment. The restriction site is functional in the SDA reaction. The oligonucleotide probe portion is about 13 to 15 nucleotides in length in one embodiment of the invention.

Ligase chain reaction (LCR) is also carried out in accordance with known techniques. In general, the reaction is carried out with two pairs of oligonucleotide probes: one pair binds to one strand of the sequence to be detected; the other pair binds to the other strand of the sequence to be detected. Each pair together completely overlaps the strand to which it corresponds. The reaction is carried out by, first, denaturing (e.g., separating) the strands of the sequence to be detected, then reacting the strands with the two pairs of oligonucleotide probes in the presence of a heat stable ligase so that each pair of oligonucleotide probes is ligated together, then separating the reaction product, and then cyclically repeating the process until the sequence has been amplified to the desired degree. Detection may then be carried out in like manner as described above with respect to PCR.

Diagnostic techniques that are useful in the methods of the invention include, but are not limited to direct DNA sequencing, pulsed-field gel electrophoresis (PFGE) analysis, allele-specific oligonucleotide (ASO), dot blot analysis and denaturing gradient gel electrophoresis, and are well known to the artisan.

The sample may be contacted with the aptamer in any suitable manner known to those skilled in the art. For example, the sample may be solubilized in solution, and contacted with the aptamer by solubilizing the aptamer in solution with the sample under conditions that permit binding. Suitable conditions are well known to those skilled in the art. Alternatively, the sample may be solubilized in solution with the aptamer immobilized on a solid support, whereby the sample may be contacted with the aptamer by immersing the solid support having the aptamer immobilized thereon in the solution containing the sample.

Diseases and Conditions Amendable to the Methods of the Invention

In the certain embodiments of the present invention, a mammalian recipient to an expression cassette of the invention has a condition that is amenable to detection or therapy using the aptamers of the present invention. In certain embodiments, the mammal has or is suspected of having vascular disease. In certain embodiments, the vascular disease is one in which the mechanism of disease development and/or progression includes smooth muscle cell activation (defined by smooth muscle cell migration and/or proliferation and/or phenotypic modulation and/or changes in gene expression). These diseases include but are not necessary limited to pulmonary hypertension, transplant vasculopathy, atherosclerosis, venous bypass graft failure, arteriovenous fistula failure, restenosis following percutaneous or surgical intravascular intervention (e.g., balloon angioplasty, atherectomy, brachytherapy, and stenting), and hypertensive vasculopathy.

Accordingly, as used herein, the term "therapeutic small molecule" refers to any small molecule that has a beneficial effect on the recipient. Thus, "therapeutic small molecule" embraces both therapeutic and prophylactic small molecules.

General Terminology

"Synthetic" aptamers are those prepared by chemical synthesis. The aptamers may also be produced by recombinant nucleic acid methods. "Recombinant nucleic molecule" is a combination of nucleic sequences that are joined together using recombinant nucleic technology and procedures used to join together nucleic sequences known in the art.

The term "chimeric" refers to a gene or DNA that contains 1) DNA sequences, including regulatory and coding sequences that are not found together in nature or 2)

sequences encoding parts of proteins not naturally adjoined, or 3) parts of promoters that are not naturally adjoined. Accordingly, a chimeric gene may include regulatory sequences and coding sequences that are derived from different sources, or include regulatory sequences and coding sequences derived from the same source, but arranged in a manner different from that found in nature.

As used herein, the term "nucleic acid" and "polynucleotide" refers to deoxyribonucleotides or ribonucleotides and polymers thereof in either single- or double-stranded form, composed of monomers (nucleotides) containing a sugar, phosphate and a base that is either a purine or pyrimidine. Unless specifically limited, the term encompasses nucleic acids containing known analogs of natural nucleotides which have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences as well as the sequence explicitly indicated. Specifically, degenerate codon substitutions may be achieved by generating sequences in which the third position of one or more selected (or all) codons is substituted with mixed-base and/or deoxyinosine residues.

A "nucleic acid fragment" is a portion of a given nucleic acid molecule. Deoxyribonucleic acid (DNA) in the majority of organisms is the genetic material while ribonucleic acid (RNA) is involved in the transfer of information contained within DNA into proteins. The term "nucleotide sequence" refers to a polymer of DNA or RNA which can be single- or double-stranded, optionally containing synthetic, non-natural or altered nucleotide bases capable of incorporation into DNA or RNA polymers.

The terms "nucleic acid," "nucleic acid molecule," "nucleic acid fragment," "nucleic acid sequence or segment," or "polynucleotide" may also be used interchangeably with gene, cDNA, DNA and RNA encoded by a gene, e.g., genomic DNA, and even synthetic DNA sequences. The term also includes sequences that include any of the known base analogs of DNA and RNA.

By "fragment" or "portion" is meant a full length or less than full length of the nucleotide sequence.

A "variant" of a molecule is a sequence that is substantially similar to the sequence of the native molecule. For nucleotide sequences, variants include those sequences that, because of the degeneracy of the genetic code, encode the identical amino acid sequence of the native protein. Naturally occurring allelic variants such as these can be identified with the use of well-known molecular biology techniques, as, for example, with polymerase chain reaction (PCR) and hybridization techniques. Variant nucleotide sequences also include synthetically derived nucleotide sequences, such as those generated, for example, by using site-directed mutagenesis that encode the native protein, as well as those that encode a polypeptide having amino acid substitutions. Generally, nucleotide sequence variants of the invention will have in at least one embodiment 40%, 50%, 60%, to 70%, e.g., 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, to 98%, sequence identity to the native (endogenous) nucleotide sequence.

As used herein, "sequence identity" or "identity" in the context of two nucleic acid sequences makes reference to a specified percentage of residues in the two sequences that are the same when aligned by sequence comparison algorithms or by visual inspection.

As used herein, "percentage of sequence identity" means the value determined by comparing two optimally aligned sequences, wherein the portion of the polynucleotide sequence may comprise additions or deletions (i.e., gaps) as compared to the reference sequence (which does not comprise additions or deletions) for optimal alignment of the two sequences. The percentage is calculated by determining the number of positions at which the identical nucleic acid base occurs in both sequences to yield the number of matched positions, dividing the number of matched positions by the total number of positions in the window of comparison, and multiplying the result by 100 to yield the percentage of sequence identity.

The term "substantial identity" of polynucleotide sequences means that a polynucleotide comprises a sequence that has at least 70%, 71%, 72%, 73%, 74%, 75%, 76%, 77%, 78%, or 79%; at least 80%, 81%, 82%, 83%, 84%, 85%, 86%, 87%, 88%, or 89%; at least 90%, 91%, 92%, 93%, or 94%; or even at least 95%, 96%, 97%, 98%, or 99% sequence identity, compared to a reference sequence using one of the alignment programs described using standard parameters.

Another indication that nucleotide sequences are substantially identical is if two molecules hybridize to each other under stringent conditions (see below). Generally, stringent conditions are selected to be about 5° C. lower than the thermal melting point ($T_m$) for the specific sequence at a defined ionic strength and pH. However, stringent conditions encompass temperatures in the range of about 1° C. to about 20° C., depending upon the desired degree of stringency as otherwise qualified herein. Nucleic acids that do not hybridize to each other under stringent conditions are still substantially identical if the polypeptides they encode are substantially identical. This may occur, e.g., when a copy of a nucleic acid is created using the maximum codon degeneracy permitted by the genetic code.

As noted above, another indication that two nucleic acid sequences are substantially identical is that the two molecules hybridize to each other under stringent conditions. The phrase "hybridizing specifically to" refers to the binding, duplexing, or hybridizing of a molecule only to a particular nucleotide sequence under stringent conditions when that sequence is present in a complex mixture (e.g., total cellular) DNA or RNA. "Bind(s) substantially" refers to complementary hybridization between a probe nucleic acid and a target nucleic acid and embraces minor mismatches that can be accommodated by reducing the stringency of the hybridization media to achieve the desired detection of the target nucleic acid sequence.

"Stringent hybridization conditions" and "stringent hybridization wash conditions" in the context of nucleic acid hybridization experiments such as Southern and Northern hybridizations are sequence dependent, and are different under different environmental parameters. Longer sequences hybridize specifically at higher temperatures. The $T_m$ is the temperature (under defined ionic strength and pH) at which 50% of the target sequence hybridizes to a perfectly matched nucleic acid. Specificity is typically the function of post-hybridization washes, the critical factors being the ionic strength and temperature of the final wash solution. For DNA-DNA hybrids, the $T_m$ can be approximated from the equation of Meinkoth and Wahl: $T_m$ 81.5° C.+16.6 (log M)+0.41 (% GC)-0.61 (% form)-500/L. M is the molarity of monovalent cations, GC is the percentage of guanosine and cytosine nucleotides in the DNA, % form is the percentage of formamide in the hybridization, and L is the length of the hybrid in base pairs. $T_m$ is reduced by about 1° C. for each 1% of mismatching; thus, $T_m$, hybridization, and/or wash conditions can be adjusted to hybridize to sequences of the desired identity. For example, if sequences with >90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired T, those of ordinary skill will understand that variations in the stringency of hybridization and/or wash solutions are inherently described. If the desired degree of mismatching results in a T of less than 45° C. (aqueous solution) or 32° C. (formamide solution), it is preferred to increase the SSC concentration so that a higher temperature can be used. Generally, highly stringent hybridization and wash conditions are selected to be about 5° C. lower than the thermal melting point ($T_m$) for the specific sequence at a defined ionic strength and pH.

An example of highly stringent wash conditions is 0.15 M NaCl at 72° C. for about 15 minutes. An example of stringent wash conditions is a 0.2×SSC wash at 65° C. for 15 minutes. Often, a high stringency wash is preceded by a low stringency wash to remove background probe signal. An example medium stringency wash for a duplex of, e.g., more than 100 nucleotides, is 1×SSC at 45° C. for 15 minutes. An example low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.5 M, more preferably about 0.01 to 1.0 M, Na ion concentration (or other salts) at pH 7.0 to 8.3, and the temperature is typically at least about 30° C. and at least about 60° C. for long probes (e.g., >50 nucleotides). Stringent conditions may also be achieved with the addition of destabilizing agents such as formamide. In general, a signal to noise ratio of 2× (or higher) than that observed for an unrelated probe in the particular hybridization assay indicates detection of a specific hybridization.

Very stringent conditions are selected to be equal to the $T_m$ for a particular probe. An example of stringent conditions for hybridization of complementary nucleic acids which have more than 100 complementary residues on a filter in a Southern or Northern blot is 50% formamide, e.g., hybridization in 50% formamide, 1 M NaCl, 1% SDS at 37° C., and a wash in 0.1×SSC at 60 to 65° C. Exemplary low stringency conditions include hybridization with a buffer solution of 30 to 35% formamide, 1M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C.

"Operably-linked" nucleic acids refers to the association of nucleic acid sequences on single nucleic acid fragment so that the function of one is affected by the other, e.g., an arrangement of elements wherein the components so described are configured so as to perform their usual function. For example, a regulatory DNA sequence is said to be "operably linked to" or "associated with" a DNA sequence that codes for an RNA or a polypeptide if the two sequences are situated such that the regulatory DNA sequence affects expression of the coding DNA sequence (i.e., that the coding sequence or functional RNA is under the transcriptional control of the promoter). Coding sequences can be operably-linked to regulatory sequences in sense or antisense orientation. Control elements operably linked to a coding sequence are capable of effecting the expression of the coding sequence. The control elements need not be contiguous with the coding sequence, so long as they function to direct the expression thereof. Thus, for example, intervening untranslated yet transcribed sequences can be present between a promoter and the coding sequence and the promoter can still be considered "operably linked" to the coding sequence.

The terms "isolated and/or purified" refer to in vitro isolation of a nucleic acid, e.g., a DNA or RNA molecule from its natural cellular environment, and from association with other components of the cell or test solution (e.g. RNA pool), such as nucleic acid or polypeptide, so that it can be sequenced, replicated, and/or expressed. For example, "isolated nucleic acid" may be a DNA molecule containing less than 31 sequential nucleotides that is transcribed into an RNAi molecule. Such an isolated RNAi molecule may, for example, form a hairpin structure with a duplex 21 base pairs in length that is complementary or hybridizes to a sequence in a gene of interest, and remains stably bound under stringent conditions (as defined by methods well known in the art, e.g., in Sambrook and Russell, 2001). Thus, the RNA or DNA is "isolated" in that it is free from at least one contaminating nucleic acid with which it is normally associated in the natural source of the RNA or DNA and is preferably substantially free of any other mammalian RNA or DNA. The phrase "free from at least one contaminating source nucleic acid with which it is normally associated" includes the case where the nucleic acid is reintroduced into the source or natural cell but is in a different chromosomal location or is otherwise flanked by nucleic acid sequences not normally found in the source cell, e.g., in a vector or plasmid.

Nucleic acid molecules having base substitutions (i.e., variants) are prepared by a variety of methods known in the art. These methods include, but are not limited to, isolation from a natural source (in the case of naturally occurring sequence variants) or preparation by oligonucleotide-mediated (or site-directed) mutagenesis, PCR mutagenesis, and cassette mutagenesis of an earlier prepared variant or a non-variant version of the nucleic acid molecule.

"Operably-linked" refers to the association of nucleic acid sequences on single nucleic acid fragment so that the function of one of the sequences is affected by another. For example, a regulatory DNA sequence is said to be "operably linked to" or "associated with" a DNA sequence that codes for an RNA or a polypeptide if the two sequences are situated such that the regulatory DNA sequence affects expression of the coding DNA sequence (i.e., that the coding sequence or functional RNA is under the transcriptional control of the promoter). Coding sequences can be operably-linked to regulatory sequences in sense or antisense orientation.

As used herein, the term "derived" or "directed to" with respect to a nucleotide molecule means that the molecule has complementary sequence identity to a particular molecule of interest.

"Treating" as used herein refers to ameliorating at least one symptom of, curing and/or preventing the development of a disease or a condition.

Disclosed herein is a strategy that results in substantial silencing of targeted genes via RNAi. Use of this strategy results in markedly diminished in vitro and in vivo expression of targeted genes. This strategy is useful in reducing expression of targeted genes in order to model biological processes or to provide therapy for human diseases. For example, this strategy can be applied to a the treatment of cancer. As used herein the term "substantial silencing" means that the mRNA of the targeted gene is inhibited and/or degraded by the presence of the introduced siRNA, such that expression of the targeted gene is reduced by about 10% to 100% as compared to the level of expression seen when the siRNA is not present. Generally, when a gene is substantially silenced, it will have at least 40%, 50%, 60%, to 70%, e.g., 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, 98%, 99% or even 100% reduction expression as compared to when the siRNA is not present. As used herein the term "substantially normal activity" means the level of expression of a gene when an siRNA has not been introduced to a cell.

To accomplish intracellular expression of the therapeutic RNAi molecules, an RNA molecule is constructed containing two complementary strands or a hairpin sequence (such as a 21-bp hairpin) representing sequences directed against the gene of interest. The RNAi molecule, or a nucleic acid encoding the RNAi molecule, is introduced to the target cell, such as a diseased brain cell. The RNAi molecule reduces target mRNA and protein expression.

The construct encoding the therapeutic RNAi molecule is configured such that the one or more strands of the RNAi molecules are encoded by a nucleic acid that is immediately contiguous to a promoter. In one example, the promoter is a pol II promoter. If a pol II promoter is used in a particular construct, it is selected from readily available pol II promoters known in the art, depending on whether regulatable, inducible, tissue or cell-specific expression of the siRNA is desired. The construct is introduced into the target cell, allowing for diminished target-gene expression in the cell.

The present invention provides an expression cassette containing an isolated nucleic acid sequence encoding an RNAi molecule targeted against a gene of interest. The RNAi molecule may form a hairpin structure that contains a duplex structure and a loop structure. The loop structure may be the aptamer portion. The duplex is less than 30 nucleotides in length, such as from 19 to 25 nucleotides. The RNAi molecule may further contain an overhang region. Such an overhang may be a 3' overhang region or a 5' overhang region. The overhang region may be, for example, from 1 to 6 nucleotides in length. The expression cassette may further contain a pol II promoter, as described herein. Examples of pol II promoters include regulatable promoters and constitutive promoters. For example, the promoter may be a CMV or RSV promoter. The expression cassette may further contain a polyadenylation signal, such as a synthetic minimal polyadenylation signal. The nucleic acid sequence may further contain a marker gene or stuffer sequences. The expression cassette may be contained in a viral vector. An appropriate viral vector for use in the present invention may be an adenoviral, lentiviral, adeno-associated viral (AAV), poliovirus, herpes simplex virus (HSV) or murine Maloney-based viral vector. The gene of interest may be a gene associated with a condition amenable to siRNA therapy. Examples of such conditions include neurodegenerative diseases, such as a trinucleotide-repeat disease (e.g., polyglutamine repeat disease). Examples of these diseases include Huntington's disease or several spinocerebellar ataxias. Alternatively, the gene of interest may encode a ligand for a chemokine involved in the migration of a cancer cell, or a chemokine receptor.

The present invention also provides an expression cassette containing an isolated nucleic acid sequence encoding a first segment, a second segment located immediately 3' of the first segment, and a third segment located immediately 3' of the second segment, wherein the first and third segments are each less than 30 base pairs in length and each more than 10 base pairs in length, and wherein the sequence of the third segment is the complement of the sequence of the first segment, and wherein the isolated nucleic acid sequence functions as an RNAi molecule targeted against a gene of interest. The expression cassette may be contained in a vector, such as a viral vector.

The present invention provides a method of reducing the expression of a gene product in a cell by contacting a cell with an expression cassette described above. It also provides a method of treating a patient by administering to the patient a composition of the expression cassette described above.

The present invention further provides a method of reducing the expression of a gene product in a cell by contacting a cell with an expression cassette containing an isolated nucleic acid sequence encoding a first segment, a second segment located immediately 3' of the first segment, and a third segment located immediately 3' of the second segment, wherein the first and third segments are each less than 30 base pairs in length and each more than 10 base pairs in length, and wherein the sequence of the third segment is the complement of the sequence of the first segment, and wherein the isolated nucleic acid sequence functions as an RNAi molecule targeted against a gene of interest.

The present method also provides a method of treating a patient, by administering to the patient a composition containing an expression cassette, wherein the expression cassette contains an isolated nucleic acid sequence encoding a first segment, a second segment located immediately 3' of the first segment, and a third segment located immediately 3' of the second segment, wherein the first and third segments are each less than 30 bases in length and each more than 10 bases in length, and wherein the sequence of the third segment is the complement of the sequence of the first segment, and wherein the isolated nucleic acid sequence functions as an RNAi molecule targeted against a gene of interest.

An RNAi molecule may be a "small interfering RNA" or "short interfering RNA" or "siRNA" or "short hairpin RNA" or "shRNA" or "microRNA" or "miRNA." An RNAi molecule an RNA duplex of nucleotides that is targeted to a nucleic acid sequence of interest. As used herein, the term "RNAi molecule" is a generic term that encompasses the subset of shRNAs. A "RNA duplex" refers to the structure formed by the complementary pairing between two regions of a RNA molecule. RNAi molecule is "targeted" to a gene in that the nucleotide sequence of the duplex portion of the RNAi molecule is complementary to a nucleotide sequence of the targeted gene. In certain embodiments, the RNAi molecules are targeted to the sequence encoding Plk1. In some embodiments, the length of the duplex of RNAi molecules is less than 30 base pairs. In some embodiments, the duplex can be 29, 28, 27, 26, 25, 24, 23, 22, 21, 20, 19, 18, 17, 16, 15, 14, 13, 12, 11 or 10 base pairs in length. In some embodiments, the length of the duplex is 19 to 25 base pairs in length. In certain embodiment, the length of the duplex is 19 or 21 base pairs in length. The RNA duplex portion of the RNAi molecule can be part of a hairpin structure. In addition to the duplex portion, the hairpin structure may contain a loop portion positioned between the two sequences that form the duplex. In certain embodiments, the loop is 9 nucleotides in length. The hairpin structure can also contain 3' or 5' overhang portions. In some embodiments, the overhang is a 3' or a 5' overhang 0, 1, 2, 3, 4 or 5 nucleotides in length.

A "small interfering" or "short interfering RNA" or siRNA is a RNA duplex of nucleotides that is targeted to a gene interest. A "RNA duplex" refers to the structure formed by the complementary pairing between two regions of a RNA molecule. siRNA is "targeted" to a gene in that the nucleotide sequence of the duplex portion of the siRNA is complementary to a nucleotide sequence of the targeted gene. In some embodiments, the length of the duplex of siRNAs is less than 30 nucleotides. In some embodiments, the duplex can be 29, 28, 27, 26, 25, 24, 23, 22, 21, 20, 19, 18, 17, 16, 15, 14, 13, 12, 11 or 10 nucleotides in length. In some embodiments, the length of the duplex is 19-25 nucleotides in length. The RNA duplex portion of the siRNA can be part of a hairpin structure. In addition to the duplex portion, the hairpin structure may contain a loop portion positioned between the two sequences that form the duplex. The loop can vary in length. In some embodiments the loop is 5, 6, 7, 8, 9, 10, 11, 12 or 13 nucleotides in length. The hairpin structure can also contain 3' or 5' overhang portions. In some embodiments, the overhang is a 3' or a 5' overhang 0, 1, 2, 3, 4 or 5 nucleotides in length. The "sense" and "antisense" sequences can be attached to the aptamer portion to form aptamer chimeras. As used herein, the term RNAi molecule is meant to be equivalent to other terms used to describe nucleic acid molecules that are capable of mediating sequence specific RNAi, for example, double-stranded RNA (dsRNA), micro-RNA (miRNA), short hairpin RNA (shRNA), short interfering oligonucleotide, short interfering nucleic acid, post-transcriptional gene silencing RNA (ptgsRNA), and others. In addition, as used herein, the term RNAi is meant to be equivalent to other terms used to describe sequence specific RNA interference, such as post transcriptional gene silencing, translational inhibition, or epigenetic silencing. In a non-limiting example, modulation of gene expression by siRNA molecules of the invention can result from siRNA mediated cleavage of RNA (either coding or non-coding RNA) via RISC, or alternately, translational inhibition as is known in the art.

The RNAi molecule can be encoded by a nucleic acid sequence, and the nucleic acid sequence can also include a promoter. The nucleic acid sequence can also include a polyadenylation signal. In some embodiments, the polyadenylation signal is a synthetic minimal polyadenylation signal.

The RNAi molecule can be encoded by a nucleic acid sequence, and the nucleic acid sequence can also include a promoter. The nucleic acid sequence can also include a polyadenylation signal. In some embodiments, the polyadenylation signal is a synthetic minimal polyadenylation signal.

"Knock-down," "knock-down technology" refers to a technique of gene silencing in which the expression of a target gene is reduced as compared to the gene expression prior to the introduction of the RNAi molecule, which can lead to the inhibition of production of the target gene product. The term "reduced" is used herein to indicate that the target gene expression is lowered by 1-100%. In other words, the amount of RNA available for translation into a polypeptide or protein is minimized. For example, the amount of protein may be reduced by 10, 20, 30, 40, 50, 60, 70, 80, 90, 95, or 99%. In some embodiments, the expression is reduced by about 90% (i.e., only about 10% of the amount of protein is observed a cell as compared to a cell where RNAi molecules have not been administered). Knock-down of gene expression can be directed, for example, by the use of dsRNAs, siRNAs or miRNAs.

"RNA interference (RNAi)" is the process of sequence-specific, post-transcriptional gene silencing initiated by an RNAi molecule. During RNAi, RNAi molecules induce degradation of target mRNA with consequent sequence-specific inhibition of gene expression. RNAi involving the use of RNAi molecules has been successfully applied to knockdown the expression of specific genes in plants, *D. melanogaster, C. elegans*, trypanosomes, planaria, hydra, and several vertebrate species including the mouse.

The term "suppressing" refers to the diminution, reduction or elimination in the number or amount of transcripts present in a particular cell.

The terms "protein," "peptide" and "polypeptide" are used interchangeably herein.

A "vector" is defined to include, inter alia, any viral vector, as well as any plasmid, cosmid, phage or binary vector in double or single stranded linear or circular form that may or may not be self transmissible or mobilizable, and that can transform prokaryotic or eukaryotic host either by integration into the cellular genome or exist extrachromosomally (e.g., autonomous replicating plasmid with an origin of replication).

"Expression cassette" as used herein means a nucleic acid sequence capable of directing expression of a particular nucleotide sequence in an appropriate host cell, which may include a promoter operably linked to the nucleotide sequence of interest that may be operably linked to termination signals. The coding region usually codes for a functional RNA of interest, for example an RNAi molecule. The expression cassette including the nucleotide sequence of interest may be chimeric. The expression cassette may also be one that is naturally occurring but has been obtained in a recombinant form useful for heterologous expression. The expression of the nucleotide sequence in the expression cassette may be under the control of a constitutive promoter or of a regulatable promoter that initiates transcription only when the host cell is exposed to some particular stimulus. In the case of a multicellular organism, the promoter can also be specific to a particular tissue or organ or stage of development.

Such expression cassettes can include a transcriptional initiation region linked to a nucleotide sequence of interest. Such an expression cassette is provided with a plurality of restriction sites for insertion of the gene of interest to be under the transcriptional regulation of the regulatory regions. The expression cassette may additionally contain selectable marker genes.

Dosages, Formulations and Routes of Administration of the Agents of the Invention The agents of the invention are preferably administered so as to result in a reduction in at least one symptom associated with a disease. The amount administered will vary depending on various factors including, but not limited to, the composition chosen, the particular disease, the weight, the physical condition, and the age of the mammal, and whether prevention or treatment is to be achieved. Such factors can be readily determined by the clinician employing animal models or other test systems, which are well known to the art.

Administration of the aptamer chimera may be accomplished through the administration of the nucleic acid molecule. Pharmaceutical formulations, dosages and routes of administration for nucleic acids are generally known in the art.

The present invention envisions treating a disease, for example, vascular stenosis, restenosis or stroke, in a mammal by the administration of an agent, e.g., a nucleic acid composition, an expression vector, or a viral particle of the invention. Administration of the therapeutic agents in accordance with the present invention may be continuous or intermittent, depending, for example, upon the recipient's physiological condition, whether the purpose of the administration is therapeutic or prophylactic, and other factors known to skilled practitioners. The administration of the agents of the invention may be essentially continuous over a preselected period of time or may be in a series of spaced doses. Both local and systemic administration is contemplated.

One or more suitable unit dosage forms having the therapeutic agent(s) of the invention, which, as discussed below, may optionally be formulated for sustained release (for example using microencapsulation), can be administered by a variety of routes including parenteral, including by intravenous and intramuscular routes, as well as by direct injection into the diseased tissue. In another example, the therapeutic agent may be introduced intramuscularly for viruses that traffic back to affected neurons from muscle, such as AAV, lentivirus and adenovirus. The formulations may, where appropriate, be conveniently presented in discrete unit dosage forms and may be prepared by any of the methods well known to pharmacy. Such methods may include the step of bringing into association the therapeutic agent with liquid carriers, solid matrices, semi-solid carriers, finely divided solid carriers or combinations thereof, and then, if necessary, introducing or shaping the product into the desired delivery system.

When the therapeutic agents of the invention are prepared for administration, they are preferably combined with a pharmaceutically acceptable carrier, diluent or excipient to form a pharmaceutical formulation, or unit dosage form. The total active ingredients in such formulations include from 0.1 to 99.9% by weight of the formulation. A "pharmaceutically acceptable" is a carrier, diluent, excipient, and/or salt that is compatible with the other ingredients of the formulation, and not deleterious to the recipient thereof. The active ingredient for administration may be present as a powder or as granules, as a solution, a suspension or an emulsion.

Pharmaceutical formulations containing the therapeutic agents of the invention can be prepared by procedures known in the art using well known and readily available ingredients. The therapeutic agents of the invention can also be formulated as solutions appropriate for parenteral administration, for instance by intramuscular, subcutaneous or intravenous routes.

The pharmaceutical formulations of the therapeutic agents of the invention can also take the form of an aqueous or anhydrous solution or dispersion, or alternatively the form of an emulsion or suspension.

Thus, the therapeutic agent may be formulated for parenteral administration (e.g., by injection, for example, bolus injection or continuous infusion) and may be presented in unit dose form in ampules, pre-filled syringes, small volume infusion containers or in multi-dose containers with an added preservative. The active ingredients may take such forms as suspensions, solutions, or emulsions in oily or aqueous vehicles, and may contain formulatory agents such as suspending, stabilizing and/or dispersing agents. Alternatively, the active ingredients may be in powder form, obtained by aseptic isolation of sterile solid or by lyophilization from solution, for constitution with a suitable vehicle, e.g., sterile, pyrogen-free water, before use.

It will be appreciated that the unit content of active ingredient or ingredients contained in an individual aerosol dose of each dosage form need not in itself constitute an effective amount for treating the particular indication or disease since the necessary effective amount can be reached by administration of a plurality of dosage units. Moreover, the effective amount may be achieved using less than the dose in the dosage form, either individually, or in a series of administrations.

The pharmaceutical formulations of the present invention may include, as optional ingredients, pharmaceutically acceptable carriers, diluents, solubilizing or emulsifying agents, and salts of the type that are well-known in the art. Specific non-limiting examples of the carriers and/or diluents that are useful in the pharmaceutical formulations of the present invention include water and physiologically acceptable buffered saline solutions such as phosphate buffered saline solutions pH 7.0-8.0, saline solutions, and water.

Example 1

Rapid Identification of Cell-Specific, Internalizing RNA Aptamers with Bioinformatics Analysis of a Cell-Based Aptamer Selection Nucleic acid aptamers represent an emerging class of pharmaceuticals under development for diagnostic and therapeutic use. Some properties of aptamers that make them promising therapeutic reagents include the intermediate size of aptamers, ease of development, and absence of synthesis constraints associated with small molecule inhibitors and protein-based drugs (e.g., antibodies). Aptamers routinely achieve binding affinities and specificities comparable to therapeutic antibodies. In addition, due to their amenability to modification by medicinal chemistry, aptamers avoid the immunogenicity concerns of protein-based drugs and can be engineered to have optimized pharmacokinetic (PK) and pharmacodynamic (PD) profiles for in vivo applications (1,2). Furthermore, aptamers can be generated to a range of therapeutic targets more efficiently than is the case for small molecules, high-throughput drug screens or cell-based antibody production.

Isolation of aptamers with affinity and specificity for a target of interest involves iterative rounds of affinity purification and amplification via a process termed SELEX (Systematic Evolution of Ligands by EXponential enrichment) (3,4). In a typical SELEX experiment, a random sequence oligonucleotide library (with approximately $1 \times 10^{15}$ sequences) is incubated with a protein target. The protein-bound aptamers are then specifically recovered and amplified by PCR. Single stranded DNA or RNA sequences are then generated from the amplified product and used in a subsequent round of selection. Since the invention of the SELEX process around 1990, many high affinity aptamers that target a wide-range of proteins including transcription factors (5-8), cytokines (9), growth factors (10-13), proteases (14, 15), serum proteins (16-18), cell-surface receptors (19-24), cell-adhesion molecules (25-28) and viral proteins (3, 29-31_ have been identified.

Although the traditional SELEX method utilizes a soluble, pure form of the target protein (i.e., recombinant protein), different methods have also been developed that target aptamers to membrane-associated cell surface proteins, termed whole-cell SELEX) (21, 24, 32-38). Like traditional SELEX, whole-cell SELEX is an evolutionary approach, yet whole-cell SELEX allows the selection of aptamers without prior knowledge of specific targets (36-39). Furthermore, whole-cell SELEX can, in principle, generate aptamers to multiple targets in parallel while favoring accessible cell surface epitopes. A major advantage of the whole-cell SELEX method over the traditional in vitro SELEX approach is that it facilitates the identification of aptamer sequences that recognize the target (e.g. membrane receptor) in its native milieu; that is, in the context of the cellular membrane. Importantly, this approach overcomes the difficulties in obtaining purified preparations of recombinant membrane proteins (1, 40). In addition, whole-cell SELEX eliminates the risk that one could select aptamers that will only bind to the purified protein and do not recognize the native form of the protein on living cells.

Aptamers that bind to extracellular targets have high potential for diagnostic and therapeutic applications. For diagnostics, aptamers are used to differentiate among different cell types, such as normal and tumor cells (28). For therapeutic applications, aptamers that bind to the cell surface can be used directly as activators or inhibitors, or indirectly to direct therapeutics, including small molecule drugs, radioisotopes, toxins or siRNAs, to persist in the vicinity of a specific cell or tissue type (2). The latter strategy is likely to increase efficacy as well as reduce potential unwanted toxic effects of the therapy. In addition, these reagents can also potentially be used to deliver therapeutics into the cells by increasing the rate of receptor-mediated endocytosis (41).

While whole cell-SELEX has increased the repertoire of aptamers that bind to membrane receptors (21,33), this methodology does not necessarily select for aptamers capable of accessing intracellular compartments for delivering macromolecules into cells. To isolate RNA aptamers that internalize into target cells, we have recently developed a novel cell-based selection strategy that we refer to as cell-internalization SELEX (24). The present approach has several advantages over the traditional in vitro SELEX approach: (1) it favors the isolation of RNAs that bind to receptors in their native state; and (2) it enriches for RNAs that are internalized by the target cell. Using the cell-internalization SELEX approach, we enriched for aptamers that selectively bind to and internalize into HER2$^+$-breast cancer cells for delivering therapeutic siRNAs to the cancer cells (24).

A potential downside to the cell-based SELEX approaches as compared to traditional in vitro SELEX is that cells are much more complex targets than single recombinant proteins. Two major challenges for cell-based aptamer selections are 1) insufficient methods to monitor the progression of a cell-based selection, and 2) the complexity of aptamer sequences derived from this type of selection. We address these issues by applying a combination of HTS and bioinformatics analysis to the cell-internalization SELEX approach. In this study, we demonstrate the usefulness of this approach by identifying vascular smooth muscle cell (VSMC)-specific internalizing aptamers. We also demonstrate the importance of categorizing aptamers based on structural similarity (structure families), in addition to sequence similarity (sequence families), in order to encourage the identification of functional sequences. In summary, these studies demonstrate the utility of HTS and bioinformatics analysis for facilitating the rapid identification of 'winner' sequences from an aptamer selection performed against a complex target. Furthermore, these studies have resulted in several VSMC-specific internalizing RNA sequences that could be used to deliver siRNAs or other small molecule drugs specifically to VSMCs.

Results

Enrichment of VSMC-Specific Internalizing RNA Aptamers

Figure 1:
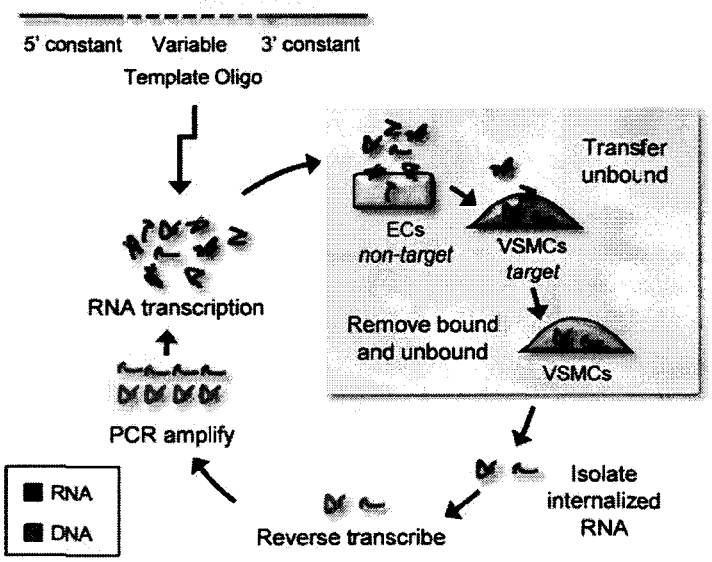
FIG. 1. Cell-Internalization SELEX (ystematic evolution of ligands by exponential enrichment). (A) Schematic of the methodology used to isolate aptamers that specifically internalize into vascular smooth muscle cells (VSMCs; target).
Figure 1:
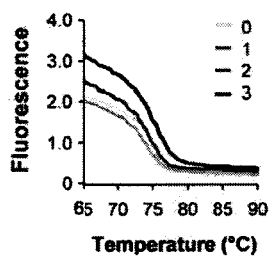
Figure 1:
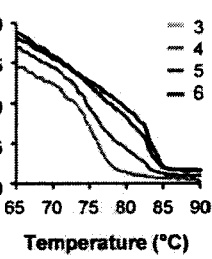
Figure 1:
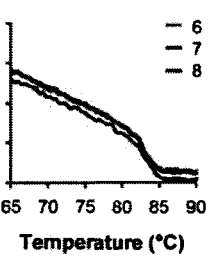
Figure 1:
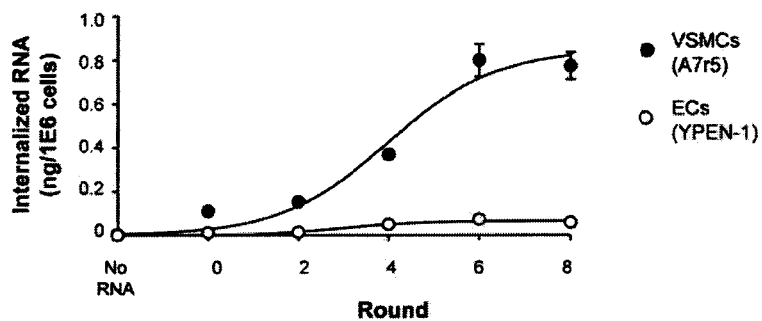

Aptamers that selectively internalize into vascular smooth muscle cells (VSMCs; A7r5) were enriched using the cell-internalization SELEX protocol (FIG. 1A). The cell-internalization SELEX protocol involves incubating pools of RNAs from an RNA library with a non-target cell (negative selection) and a target cell (positive selection) (FIG. 1A). Rounds 1 through 3 of selection were performed against target VSMCs (A7r5) using positive selection criteria (Table 1). RNA was incubated with cells for 90 minutes, based on a predetermined time for maximizing RNA internalization into these cells (FIG. 6). To enable the identification of VSMC-specific sequences, a negative selection step against endothelial cells (ECs; YPEN-1) was introduced at rounds 4 through 8 of selection (Table 4). Importantly, to enrich for RNA aptamers that internalize into the target VSMCs, we introduced a stringent salt wash to remove any unbound RNA and to reduce surface-bound RNAs.

TABLE 1

Selection conditions

| Round | [RNA] | Pre-clear Cell Line | Pre-clear Time | Internalization Cell Line | Internalization Time (min.) |
|---|---|---|---|---|---|
| 1 | 150 nM | | | A7r5 | 90 min. |
| 2 | 150 nM | | | A7r5 | 90 min. |
| 3 | 150 nM | | | A7r5 | 90 min. |
| 4 | 150 nM | 1x YPEN-1 | 20 min. | A7r5 | 60 min. |
| 5 | 150 nM | 1x YPEN-1 | 20 min. | A7r5 | 60 min. |
| 6 | 150 nM | 1x YPEN-1 | 20 min. | A7r5 | 60 min. |
| 7 | 150 nM | 2x YPEN-1 | 2x 10 min. | A7r5 | 30 min. |
| 8 | 150 nM | 2x YPEN-1 | 2x 10 min. | A7r5 | 30 min. |

We monitored the progression of the selection by measuring the complexity of the RNA pools at each round of selection using a modified DiStRO DNA melt assay (42) (FIG. 1B-D). The DNA melt assay allows for rapid and cost-effective analysis of selection progression and can be easily applied to complex cell-based selections. In this assay, the DNA from a given selection round (from the PCR amplification SELEX step) is heated at high temperatures (melted) and, as the temperature is decreased, the efficiency of re-annealing of the melted DNA is measured by SYBR green fluorescence. A relative loss in library complexity is indicative of a shift in the DNA melt curve towards higher temperatures. A significant drop in library complexity was observed between rounds 2 and 3 of selection as evidenced by the shift in the round 3 DNA melt curve towards higher temperatures, compared to the DNA melt curves of rounds 0 through 2 (FIG. 1B). This initial drop in library complexity was an indication that additional selective pressures could be introduced to further enrich for VSMCs-specific RNA aptamers. Thus, a negative-selection step (pre-clear against YPEN-1 cells) was introduced at round 4 of selection (Table 1). In addition, to enrich for RNA aptamers that are more rapidly internalized into VSMCs (A7r5), we reduced the time the RNA pool was incubated on cells from 90 minutes to 60 minutes (Table 1). These selection pressures were maintained for three consecutive rounds (rounds, 4, 5 and 6) until no further changes in library complexity were observed (Table 1 and FIG. 1C). At this point, we introduced additional selective pressures into each round: a second negative-selection step and a shorter incubation time for the RNA pools with VSMCs (Table 1). Interestingly, a DNA melt assay performed on rounds 6, 7 and 8 of selection indicated no further increase in convergence (FIG. 1D). These data suggest that selection convergence was achieved at round 6 and that further rounds of selection may not be necessary.

We next verified cell-specific internalization of the RNA pools at each round of selection (FIG. 1E). RNA from rounds 0, 2, 4, 6 and 8 of selection was incubated with either VSMCs (A7r5) or ECs (YPEN-1). Those RNAs that internalized into the cells were recovered by TRIzol extraction and quantified using RT-qPCR (24). The absence of RNA was used as a negative control in this assay. Importantly, cell-specific internalization was achieved as early as round 4 of selection (FIG.

1E). Maximum internalization into VSMCs was attained at round 6 with no significant increases in VSMC internalization in subsequent rounds (FIG. 1E). These data are in concert with the data generated from the DNA melt assay (FIGS. 1B-D) and suggest that selection convergence for VSMC-specific internalizing RNAs occurred at round 6 of selection.

HTS, using Illumina sequencing technology, was performed to enable the bioinformatics analysis of millions of sequence reads from selection rounds 0, 1, 3, 5, 6, 7 and 8. We obtained a total of 2,605,039 raw reads from the sequenced rounds (Table 4). These raw reads were filtered based on the RNA library constant region sequences. After filtering, 2,546,770 total reads were obtained. Of the total filtered reads, 1,425,964 were unique reads (Table 4). After normalizing to total reads (white squares) at each round of selection, the number of unique reads (black squares) was decreased with each subsequent round (FIG. 2A). This decrease in the number of unique reads observed at later rounds of selection (rounds 4 through 8) is indicative of a decrease in library sequence complexity and an increase in library sequence enrichment.

Next, we estimated the % Sequence Complexity at each round of selection by determining the percent of unique reads relative to the total reads (Unique/Total) (data not shown). Sequence Enrichment (% Enrichment) was then determined by taking the complement of % sequence complexity (1-Unique/Total) (FIG. 2B). % Enrichment reached a plateau at round 6 of selection with no further change observed in subsequent rounds. As shown in FIG. 2B, the most pronounced changes in % Enrichment occurred between selection rounds 3 and 5. Specifically, sequence enrichment approximated 50% by round 4 of selection (FIG. 2B). Taken with the data in FIG. 1, these findings confirm that selection convergence was achieved.

We next examined RNA structural complexity/diversity by performing secondary structure predictions of the unique and total reads at each round of selection. The RNAfold algorithm of the Vienna Package (v 2.0.0) (43, 44) was used to generate the secondary structure predictions. First, we determined the minimal free energy (kcal/mol) (FIG. 2C) and ensemble free energy (data not shown) of the predicted secondary structures with the highest probability. Interestingly, we observed a decrease in both minimal free energy (kcal/mol) (FIG. 2C) and ensemble free energy (data not shown) with each progressive round of selection. The decrease in minimal free energy (kcal/mol) for the total reads (white squares) was more pronounced compared to that of the unique reads (black squares). These data suggest that the selection scheme enriched for RNA sequences with higher structural stability as compared to non-selected sequences found within round 0, which have a lower structural stability. The decrease in minimal free energy (kcal/mol) stabilized between selection rounds 4 and 6 (FIG. 2C). These data are in agreement with the data in FIGS. 1 and 2B, and suggest that structural convergence may have occurred as early as round 4 of selection.

We hypothesized that the observed decrease in minimum free energy (kcal/mol) in later selection rounds may have resulted from loss of structural diversity. Therefore, structural diversity was assessed by determining the probability (ensemble probability) of the most likely structure for a given sequence (FIG. 2D) and the diversity (ensemble diversity) of structures that a given sequence may assume (FIG. 2E). Ensemble probability (FIG. 2D) and ensemble diversity (FIG. 2E) was determined for both the unique reads (black squares) and total reads (white squares) at each round of selection. We observed a progressive increase in ensemble probability for both the unique reads (black squares) and total reads (white squares) (FIG. 2D). However, as expected, the increase in ensemble probability for the unique reads (black squares) was more pronounced compared to that of the total reads (white squares). We observed a concordant decrease in ensemble diversity with progressive rounds of selection for both the unique (black squares) and total (white squares) reads (FIG. 2E). As expected, the decrease in ensemble diversity was more pronounced for the unique reads (black squares) than for the total reads (white squares). Together, these data suggest that the selection converged towards fewer possible structures with higher structural probability and stability.

Bioinformatics Analysis of HTS Data from Selection Rounds

Previously, we reported that nucleotide (nt) deletions or insertions within the variable region of a DNA or RNA SELEX library can occur during the course of a selection. Therefore, we examined the variable region nucleotide length of unique reads from selection round 0 (gray bars) and round 8 (black bars) (FIG. 3A). As expected, the mode variable region length was 20 nucleotides for both round 0 (gray bars) and round 8 (black bars). However, the average variable region length was significantly ($p<0.001$) higher in round 8 (black bars) compared to round 0 (gray bars) (FIG. 3A). The increase in the average variable region length observed in round 8 (black bars) was most likely due to an increase in frequency of RNA sequences with a 21-nucleotide variable region length. Interestingly, we also observed a higher frequency of sequences with 19-nucleotide variable region length in round 0 which were not present (or likely, were not selected) in later rounds (FIG. 3A). Based on these observations, we included sequences with variable region lengths ranging from 18 to 22 nucleotides in our subsequent analyses.

We next analyzed the high-throughput sequencing data to separate true-selected sequences from non-selected sequences. We postulated that rounds 1 through 8 would contain a mixture of true-selected sequences and non-selected sequences, while non-selected sequences would be predominantly found in round 0. First, we examined the recurrence of a given unique read between sequenced rounds by comparing the number of unique reads from round 0 and rounds 1-8 to the number of rounds sequenced (i.e., 7 rounds: rounds 0, 1, 3, 5-8) (FIG. 3B). As expected, all unique reads analyzed were present in at least one sequenced round (FIG. 3B). By contrast, none of the unique reads from rounds 1 through 8 were found in round 0, suggesting that complete coverage of the round 0 library was not achieved through Illumina sequencing, even after sequencing the round 0 library twice (Table 4). Importantly, thousands of unique reads from rounds 1 through 8 where found in two or more rounds, with many unique reads found in as many as six rounds (FIG. 3B). These data suggest that 'true-selected' sequences are more likely to appear in multiple rounds compared to non-selected sequences. Furthermore, the number of rounds in which a unique read is found may be used as a cut-off to separate 'true-selected' sequences from non-selected sequences. In this case, we favored a low-stringency cut-off. For example, we considered a 'true-selected' sequence to be a sequence that was present in at least two or more rounds of selection.

Next, we reasoned that an additional measure of a true selected sequence would be its cluster size, which is the number of duplicate sequence reads in each round. Thus, we compared the number of unique reads within round 0 and rounds 1-8 to cluster size (FIG. 3C). The most represented cluster size for unique reads within rounds 1-8 and round 0 was a cluster size=1 (FIG. 3C). As anticipated, unique reads in round 0 are represented by small cluster sizes (<10 duplicate reads), such that only one unique read within round 0 had a cluster size greater than eight reads (FIG. 3C). However, this unique read contained a continuous string of cytosine and thus was likely a sequencing error that was amplified thirty times (30 reads; ▼). In contrast, unique reads in rounds 1 through 8 are represented by large cluster sizes (>10 duplicate reads) (FIG. 3C). These data suggest that cluster size can be used to separate 'true-selected' sequences from non-selected sequences. In this case, the initial substantial difference in cluster size between unique reads detected in round 0 and rounds 1-8 was observed at cluster size=3 (FIG. 3C, see inset).

Taken together, the number of rounds in which a given sequence is found (FIG. 3B) and its cluster size (FIG. 3C) may be combined to separate 'true selected' sequences from non-selected sequences. Based on these analytical parameters, a 'true selected' sequence from the cell-based VSMC selection described herein is more likely to be present in two or more rounds and have a cluster size of 3 reads. Thus, for subsequent analyses, if a sequence was detected in two or more rounds and had a cluster size of at least three reads, it was considered a 'true selected' sequence.

Edit and Tree Distance Analyses

Candidate aptamers derived from selection efforts are often categorized based on sequence homology (24, 25) and sequence motifs (8, 46). We have expanded these analyses to include a novel pairwise comparison of each aptamer sequence using the concept of edit distance (FIG. 4A). Edit distance is defined as the number of changes (substitution/insertion/deletion) necessary for two sequences to become identical. For example, closely-related sequences have a low edit distance, while unrelated or loosely-related sequences are denoted by a high edit distance.

We next determined the edit distance for sequences within rounds 1-8 that were categorized as 'true selected' sequences based on the analyses described in FIGS. 3B and C. A total of 2312 unique reads (see excel/CVS data file 1), representing 1,123,533 total reads, were analyzed for edit distance (FIG. 8; output for edit distance=1 shown) by the program process.seqs (FIG. 4A). As seen in FIG. 4A, all unique sequences interconnect at edit distance=9 (red node). Unique sequences that interconnect at edit distance=1 (blue), 2 (cyan), 3 (green), 4 (yellow), and 9 (red) are shown (FIG. 4A). The most significant clustering of sequences was observed at an edit distance of 1. The dendrogram in FIG. 4A was used to identify families of related sequences and to determine how far apart (in edit distance) the sequence families were from each other. At each edit distance node, the robustness of clustering of related sequences was determined using ClustalX multiple sequence alignments (see Methods for details). From these alignments, 13 distinct sequence families (I-XIII) at 1 edit distance apart were established (FIG. 4A).

Although selected aptamers are typically categorized based on sequence similarity, we asked whether selected aptamers could also be analyzed and categorized by structural similarity. The secondary structure with the highest probability for each of the 2312 unique reads (1,123,533 total reads) was predicted using RNAfold. Each unique read was assumed to have only a single structure, which is supported by the data in FIGS. 2D and E that suggest that selected sequences have a higher structural probability and low structural diversity, respectively, when compared to non-selected sequences. A pairwise comparison for each structure was performed using the concept of tree distance, which describes the relatedness of two structures by calculating the dissimilarity between two structures. Analogous with edit distance, closely-related structures have a low tree distance, while unrelated or loosely-related structures are denoted by a large tree distance. Unique sequences were analyzed for tree distance (FIG. 4B). The data output derived from tree distance=3 analysis is shown (FIG. 9). All of the predicted structures connected with tree distances ranging from 0 (representing an identical structure of a different sequence) to 22 (red node). LocARNA multiple sequence/structure alignments of the predicted RNA structures at the various tree distances were used to establish structure families (see Methods for details). Eight structure families (A-H) were identified and ranged from a tree distance of 3 to a tree distance of 6 (FIG. 4B).

Next, single representative RNA aptamer sequences were selected from each sequence (FIG. 4A) or each structure family (FIG. 4B) based on the following parameters: (1) fold enrichment (8, 46) (2) 'rising', defined by the increasing trend in read number over progressive rounds of selection, (3) read number, defined by total reads in a given round and (4) rate enrichment, defined by the change in read number over change in round number. These parameters were applied to the following rounds: rounds 1-8,1-3, 3 through 8 and 6 through 8, based on the selection conditions described in Table 1. The analysis of the rounds based on the above parameters resulted in a total of 27 representative aptamer sequences derived from the 13 edit distance sequence families and a total of 31 representative aptamer sequences derived from the eight tree distance structure families (FIG. 4C). Interestingly, while 26 out of 32 the RNA sequences were identified by both methods, some aptamer sequences were only identified by the edit distance analysis (1 out of 32) or the tree distance analysis (5 out of 32) (FIG. 4C). In addition, a single highly represented sequence denoted as 'orphan' (FIG. 4C) did not group with any of the families derived from the edit distance or tree distance analyses. This sequence comprised a total of 506 reads and was chosen, along with the other 32 sequences, for a total of 33 single RNA aptamers for subsequent analysis.

Internalization of Single Aptamers into VSMCs

To evaluate aptamer internalization, the 33 individual RNA aptamers identified in FIG. 4 were incubated with either VSMCs (A7r5) or EC (YPEN-1) cells and the RT-qPCR fold internalization into VSMCs over ECs was calculated after recovery of aptamers (FIG. 5A, B). All tested aptamers internalized preferentially into VSMCs (A7r5) compared to ECs (YPEN-1) (FIG. 5A), though it should be noted that the degree of internalization varied from aptamer to aptamer. Approximately 82% of all screened aptamers displayed in a 4-fold greater internalization into VSMCs compared to ECs. Many of the highest internalizing aptamers were identified by both the edit distance and the tree distance analyses (FIG. 5A). The most represented aptamer, #01 (917,941 total reads) was among the better internalizing sequences (14.8±1.7 fold) (FIG. 5 B). Interestingly, the aptamer with the highest fold internalization, #51 (21.8±2.2 fold) was identified only by the tree distance analysis but not the edit distance analysis (FIG. 5A). The 'orphan' aptamer #55 displayed the poorest internalization (fold internalization <4). Together, these data highlight the importance of performing a tree distance analysis in addition to categorizing aptamers based on sequence similarity. Importantly, these data also suggest that aptamers that do not fit into either edit distance or tree distance families are likely to be 'junk' sequences and should not be included in further analyses.

Next, we performed a fluorescent-based 'plate reader' assay to confirm specific binding and internalization of our selected aptamers into VSMCs (FIG. 10). We assessed binding/internalization of two independent fluorescently-labeled aptamers (#51 and #420). As observed with the RT-qPCR assay, aptamer #51 is a strong cell-specific internalizer, while aptamer #420 is a weak cell-specific internalizer (FIG. 10). Together, these data confirm that the aptamers selectively internalize into VSMCs vs.ECs.

We used correlation analysis to determine the dependence of fold internalization (into VSMCs) and the following parameters: (1) fold enrichment (8, 46), (2) rising (trend of increasing read number across progressive rounds), (3) rate enrichment and (4) read number (Tables 2 and 3). The correlation analysis determines the dependence between two variables as defined by a correlation coefficient (r) that has a value between −1.0 and 1.0. For example, two variables with a cooperative dependence will have a positive correlation coefficient ($r>0$), whereas two variables with an opposing dependence will have a negative correlation coefficient ($r<0$). The correlation analysis also calculates the statistical significance (p-value) of the relationship between two variables as described by the correlation coefficient.

Significant positive correlation coefficients ($r>0$ and $p<0.05$) were obtained when comparing fold internalization to fold enrichment for rounds 1 through 8 and rounds 3 through 8 but not for rounds 1 through 3 and rounds 6 through 8. Similar results were obtained when comparing fold internalization to rate enrichment (Table 2). These results suggest that cell-specific internalizing aptamers are enriched after the inclusion of a negative selection step (round 4) and that further enrichment occurs after the selection has converged (rounds 6 through 8) (Table 2 and FIGS. 1B and C). In general, fold internalization positively correlated with fold enrichment (Table 2), read number (Table 3) and rate enrichment (Table 2) only after round 3 of selection, when the negative selection (performed against ECs) was introduced (Table 1). In contrast, no significant correlation was found between fold internalization and rising (Table 2). These data suggest increasing read number between rounds is not sufficient to denote specific internalization. These data collectively suggest that the above parameters coupled to selection conditions should be analyzed in order to facilitate the identification of 'winner' sequences.

TABLE 2

Correlation coefficient (r) for fold internalization vs. fold enrichment, 'rising' and rate enrichment.

| Rounds | Fold enrichment | | 'Rising' | | Rate enrichment | |
|---|---|---|---|---|---|---|
| | r | p | r | p | r | p |
| 1-3 | 0.20 | 0.341 | | | 0.02 | 0.916 |
| 1-8 | 0.52* | 0.010 | 0.27 | 0.195 | 0.54* | 0.007 |
| 3-8 | 0.47* | 0.021 | 0.36 | 0.084 | 0.50* | 0.013 |
| 6-8 | 0.35 | 0.095 | 0.18 | 0.397 | 0.26 | 0.215 |

*p < 0.05

TABLE 3

Correlation coefficient (r) for fold internalization vs. read number

| Round | r | p |
|---|---|---|
| 1 | −0.07 | 0.739 |
| 3 | 0.00 | 0.995 |
| 5 | 0.43* | 0.037 |
| 6 | 0.55* | 0.005 |
| 7 | 0.69* | 0.000 |
| 8 | 0.62* | 0.001 |
| Total | 0.70* | 0.0001 |

*p < 0.05

Discussion

The identification of candidate aptamer sequences within an enriched library is slowly shifting from traditional cloning and sequencing approaches to the use of HTS (8, 18, 24, 45-48). In spite of this trend towards more sophisticated aptamer identification approaches, the computational tools for the downstream analysis of millions of sequence reads, which result from HTS efforts, are still being streamlined. Here we describe a novel approach that couples HTS with bioinformatics tools to facilitate the identification of over 30 'winner' RNA sequences from a complex, cell-internalization aptamer selection. To identify candidate aptamer sequences, high-throughput sequence data from eight rounds of negative and positive selection were analyzed using these novel methods. Metrics for determining % Enrichment confirmed the experimental cell-internalization data suggesting the selection was complete after eight rounds of selection. Millions of 'true-selected' sequences were separated from the non-selected ones using metrics based on the number of rounds a sequence was present in and on the cluster size for each sequence. The metrics analysis for selection enrichment made it possible to sort through millions of reads and rapidly eliminate those sequences that were not selected or were present in the dataset as a result of sequencing errors. All the unique reads that comprised the 'true-selected' sequences were then clustered based on either sequence similarity using edit distance analysis or structural similarity using tree distance analysis. Importantly, these analyses resulted in the identification of sequences that would otherwise have been missed by conventional means, that is, by selecting only the top sequence reads.

The approach described herein, is of importance in light of the rise in complex target SELEX, in which aptamers are directly selected against complex protein mixtures, cells, or even whole organisms (24, 33, 36, 49-53). Many of the cell-specific aptamers generated so far have served well as neutralizing ligands (21), real-time detection probes (54, 55), as well as internalizing escorts (24). Particularly impressive, are selections performed against whole organisms (in vivo-SELEX) that include the isolation of RNA aptamers that recognize African trypanosomes (51) and *Mycobacterium tuberculosis* (52). These aptamers have the potential to target biomarkers on the surface of the parasite or bacterium and as such might be modified to function as novel drugs against these unicellular organisms. While African trypanosomes and *Mycobacterium tuberculosis* are examples of simple, unicellular organisms, complex in vivo-selections have also been attempted in order to isolate aptamers against intrahepatic carcinomas in mice (53). In this work, the authors performed intravenous injections of chemically modified RNA pools into tumor bearing mice. Those aptamers that localized to the tumors were extracted and amplified. These efforts resulted in two RNA sequences that target an intracellular, RNA binding protein (P68) overexpressed in the hepatic tumor.

Despite the complex nature of published aptamer selections, the resulting 'winner' aptamer sequences are typically few in number and, in most cases, only one sequence is identified and further characterized. The likely reason for the "one selection-one aptamer" phenomenon is that only the most highly represented sequences are sequenced using the traditional chain terminator method, i.e., Sanger sequencing (33, 36, 49-52, 56). Recently, the advent of HTS technologies has streamlined the sequencing process, allowing researchers to obtain a more comprehensive picture of all selected sequences after only a few rounds of selection (8, 18, 45, 46). Although these published studies were performed against purified, recombinant proteins, the authors observed that the sequences with the highest read number were not necessarily the highest affinity binders (8, 46). By contrast, high affinity binders had the highest fold enrichment during the course of the selection (8, 46). These findings are in agreement with our data demonstrating that cell-specific internalization of 'winner' sequences positively correlated with fold enrichment. Interestingly, although we also observed a positive correlation between fold internalization and read number, this association occurred only after the introduction of a negative selection step. Together, these studies highlight the importance of performing HTS on all rounds of selection in order to assess fold enrichment of specific sequences over the course of a selection. In addition, our data identify the negative-selection step as a key criterion to successfully enrich for cell-specific sequences (24).

To date, bioinformatics analyses performed on aptamer selections have relied predominantly on an arbitrary cutoff, typically based on read number, to identify aptamers sequences that are subsequently analyzed experimentally (8, 24, 45). While this strategy has proven effective, candidate sequences with a low read number are have a high probability of being missed or disregarded. In order to identify all possible 'winner' sequences, including those that were not highly-represented, we performed pairwise comparisons using edit distance and tree distance analyses to identify sequences that are related based on sequence or structure. These analyses resulted in the identification of 27 sequences (out of 32) that were among the best cell-specific internalizing aptamers (fold internalization ≥4). Of particular importance, the aptamer with the highest fold internalization (#51) was not among the aptamers with the highest read number. Aptamer #51 was identified only through the tree distance analysis, highlighting that RNA structure should also be considered when choosing sequences for experimental validations.

A potential current limitation of the tree distance analysis is that it is based on the assumption that each sequence has only a single predicted structure. While RNA molecules can assume multiple breathing dynamics, our data seem to indicate that structural diversity decreases over the course of a selection. However, the inclusion of all possible RNA structures may improve the outcome of current tree distance analyses, though this type of analysis is currently hindered by the existing algorithms for structure prediction. Indeed, we anticipate these multi-structure analyses are likely to become more feasible as predictive RNA structural algorithms evolve and as computational algorithms become more complex.

In conclusion, our studies highlight the utility of combining HTS with bioinformatics analysis for the identification of 'winner' sequences from an aptamer selection performed against a complex target. These efforts have yielded (1) predictive tools that are broadly applicable to all aptamer selections for target sequence identification; and (2) several VSMC-specific RNA aptamers that can subsequently be used for targeted delivery.

Materials & Methods

Cell Culture

All cell lines were cultured at 37° C. under 5% $CO_2$. The A7r5 (ATCC, CRL-1444) cell line was cultured in DMEM (Gibco, 11965) supplemented with 10% heat inactivated FBS (Atlanta biologicals, S11550) and the YPEN-1 (ATCC, CRL-2222) cell line was cultured in MEM (Gibco, 11095) supplemented with 5% heat inactivated FBS (Atlanta biologicals, S11550), 1.5 g/L Na bicarbonate (Gibco, 25080), 0.1 mM MEM NEAA (Gibco, 11140), 1.0 mM Na pyruvate (Gibco, 11360) and 0.03 mg/mL heparin (Sigma, H4784). All cell lines were screened for contamination by mycoplasma, which is known to degrade 2'-fluoro pyrimidine modified RNA aptamers (57). Both cell lines were split 1:3 or 1:4 upon reaching confluence by washing with DPBS (Gibco, 14190-144) and detaching cells using 0.25% Trypsin-EDTA (Gibco, 25200) as recommended for each cell line by ATCC. Each cell line was carried for no more than 5-6 passages. For selection rounds and internalization assays, confluent P150 (Nunc, 168381) plates of A7r5 and YPEN-1 were detached as described. Cells were counted by staining an aliquot of cells with 0.4% trypan blue (Gibco, 0618) and using a hemocytometer to count the number of live cells. A7r5 and YPEN-1 cells were plated at 5 million and 8 million cells per P150 respectively for selection rounds and 500,000 and 800,000 cells per well of a 6-well plate respectively for internalization assays. For internalization assay, extra A7r5 and YPEN-1 cells were plated in order to count the number of cells after 24 hrs in culture to normalize internalization assay data to cell number.

Cell Internalization SELEX

Generation of the Initial (Round 0) RNA Library

The duplex DNA library was generated as follows. The Sel2N20 single stranded DNA (ssDNA) template oligo, 5'-TCGGGCGAGTCGTCTG-N20-CCGCATCGTC-CTCCC-3' (SEQ ID NO: 3) (IDT, Coralville, Iowa) was extended using Choice Taq Polymerase (Denville Scientific Inc., CB4050-2) in the presence of Sel2 5' primer, 5'-TAATACGACTCACTATAGGGAGGACGATGCGG-3' (SEQ ID NO: 4). The extension reaction was performed in a thermocyler by heating the Sel2N20 ssDNA template oligo and the primer at 95° C. for 3 min, annealing at 25° C. for 10 min and extending at 72° C. for 30 min, followed by a 10 min incubation at 25° C. The duplex DNA library was in vitro transcribed for 16 hrs at 37° C. using Y639F mutant T7 RNAP (58-59) to enable incorporation of 2'-OH purines (Roche; GTP, 14611221; ATP, 14919320) and 2'-Fluoro pyrimidines (TriLink BioTechnologies; 2'-Fluoro-2'-dCTP, N-1010-020509; 2'-Fluoro-2'-dUTP, N-1008-013008) in the Round 0 RNA library. During the transcription reaction, the final concentration of rNTPs for targeted selections was 4 mM with a 3:1 ratio of 2'-F pyrimidines to 2'-OH purines (3 mM 2'-F pyrimidines and 1 mM 2'-OH purines). Duplex DNA was removed from the transcription reaction using DNase I (Roche, 04716728001) and the RNA from the transcription reaction was run on a denaturing gel (10% acrylamide; 7M urea). The band of RNA was detected by UV shadowing and excised from the gel. The excised gel fragment containing the RNA was incubated with TE buffer to elute the RNA from the gel. Eluted RNA was collected using a 10,000 MWCO centrifugal filter (Amicon Ultra-4, UFC801024) and washed with additional TE buffer. The concentration and purity of the extracted RNA was determined by OD 260/280.

Cell-Internalization SELEX for VSMC Specific Internalizing Aptamer Selection

We applied a modified cell-based SELEX (21) termed cell-internalization SELEX as previously described (24). A7r5 and YPEN-1 cells were cultured as described under cell culture methods. For each round of selection, 150 nM RNA was folded in Opti-MEM (1500 pmoles in 10 mL) by heating to 65° C. for 10 min followed by a 20 min incubation at 37° C. Folded RNA was then supplemented with 100 µg/mL yeast tRNA (Invitrogen). A7r5 and YPEN-1 cells were washed 3× with Opti-MEM (Gibco, 31985) and incubated in Opti-MEM with 100 µg/mL tRNA (Invitrogen, 15401-029) in Opti-MEM for 15 min. For rounds 1 through 3, the RNA library was added to A7r5 cells for 90 min. For rounds 4 through 6, the RNA library was pre-cleared against a single plate of YPEN-1 cells for 15 min. For rounds 7 through 8, the RNA library was pre-cleared against two plates of YPEN-1 for 15 min sequentially. For rounds 4 through 6 and 7 through 8, the unbound RNA (from pre-clear step) was collected, centrifuged (1,500 rpm, 5 min.) to pellet cell debris and added to A7r5 cells for 60 min and 30 min respectively. YPEN-1 pre-clear conditions (time and number of plates) and A7r5 selection conditions (internalization time) are summarized in Table 1.

Following incubation of the RNA library, A7r5 cells were washed 3 times with ice cold DPBS to remove unbound RNA. Cell-surface bound RNA was removed by washing cells once with ice cold 0.5 M NaCl DPBS, incubating cells 5 min at 4° C. with ice cold 0.5 M NaCl DPBS and washing once with ice cold DPBS. Internalized RNA was recovered by TRIzol (Invitrogen, 15596-026) extraction by following the manufacturer's instructions. The recovered RNA aptamers were reverse transcribed (RT) (Invitrogen, Superscript III, 56575) using the Sel2 3' primer: 5'-TCGGGCGAGTCGTCTG-3' (SEQ ID NO: 5). The RT protocol is as follows: 55° C. for 60 min followed by a 15 min incubation at 72° C. The RT product was PCR-amplified using Choice Taq DNA polymerase (Denville Scientific Inc., CB4050-2) in the presence of the Sel2 5' and Sel2 3' primers. The dNTP concentration in the PCR reaction was 2.5 mM (10 mM dNTP mix, Invitrogen, 100004893). The PCR amplification protocol is as follows. 95° C. for 2 min, followed by 25 cycles of heating to 95° C. for 30 sec, 55° C. for 30 sec and 72° C. 30 sec. A final extension step was performed for 5 min at 72° C. The DNA duplex library was in vitro transcribed as described above.

DNA Melt Assay

We used a modified DiStRO method (42) DNA melt assay to determine library complexity. SYBR green (BioRad, 170-8882) was added at a 1:1 volume to 0.5 µM DNA duplex library of each selection round in triplicate. These samples were run on a real-time PCR machine (Eppendorf, Mastercycler epgradient S with realplex$^2$) using a DNA melt assay protocol (95° C. for 15 min; 95° C. for 15 sec; 95° C.-25° C. ramp for 20 min and 25° C. for 15 sec; 4° C. hold). The raw DNA melt assay data (performed in triplicate) was averaged and plotted as fluorescence intensity (SYBR) vs. temperature)(C.°). Higher library complexity was indicated by a relative shift of the DNA melt curve towards lower temperatures, whereas, lower library complexity was a shift to higher temperatures.

Internalization Assay by Quantitative Reverse Transcription-PCR (RT-qPCR)

We applied similar RT-qPCR methods to detect internalized RNA as described previously (24, 60). A7r5 and YPEN-1 cells were incubated with 150 nM RNA aptamer library (rounds 0 through 8) or 150 nM RNA aptamer for 30 min. at 37° C. with 5% $CO_2$. Unbound and cell-surface bound RNA was removed by washing with ice-cold 0.5M NaCl DPBS. Internalized RNA was recovered by TRIzol containing 0.5 pmoles/mL M12-23 aptamer (61) as a reference control. The amount of recovered RNA was determined by performing a two-step RT-qPCR protocol. In Step one, recovered RNA was reverse transcribed using MMuLV, NEB, M0253L. The primers for the RT step were either the Sel2 3' primer or M12-23 aptamer reference control primer (5'-GGGGGGATCCAG-TACTATCGACCTCTGGGTTATG-3') (SEQ ID NO: 6). The RT protocol is as follows. The recovered RNA and the primers were heated at 65° C. for 5 min, annealed at 22° C. for 5 min and extended at 42° C. for 30 min followed by and extension at 48° C. for 30 min. In Step two, the product from the RT reaction was PCR amplified with iQ SYBR Green Supermix (BioRad, 170-8882) using a Eppendorf Mastercycler epgradient S with realplex$^2$. The qPCR protocol is as follows. The RT product was heated at 95° C. for 2 min, followed by 50 cycles of heating at 95° C. for 30 sec, annealing at 55° C. for 30 sec, and extending at 72° C. for 30 sec. A melt curve was performed by heating at 60° C.-95° C. for 20 min. Reactions were all done in 50 µL volume in triplicate with either the Sel2 5' and 3' primers or M12-23 aptamer reference control 5' (5'-GGGGGAATTCTAATACGACT-CACTATAGGGAGAGAGGAAGAGGGATGGG-3') (SEQ ID NO: 7) and 3' primers. Data were normalized to the M12-23 reference control (FIG. 7) and to cell number as determined by counting cells cultured in conjunction with each experiment.

Illumina High-Throughput Sequencing Sample Preparation

Illumina High-Throughput Sequencing Sample Preparation

The RNA pools for selection rounds 0 (in duplicate), 1, 3, 5, 6, 7 and 8 were reverse transcribed using Superscript III (Invitrogen, 56575) in the presence of the Sel2 3' primer. The RT protocol is as follows. The round RNA was heated at 55° C. for 60 min and extended at 72° C. for 15 min. The product from the RT reaction was PCR amplified using Choice Taq DNA Polymerase (Denville Scientific Inc., CB4050-2) in the presence of Illumina primers (5'-AATGATACGGCGAC-CACCGAGATCTACACTCTTTCCCTACAC-GACGCTCTTCCGATC T-8nt Barcode-GGGAGGACGAT-GCGG-3' (SEQ ID NO: 8); 5'-CAAGCAGAAGACGGCATACGAGCTCTTC-CGATCTTCGGGCGAGTCGTCTG-3' (SEQ ID NO: 9)). The PCR Protocol is as follows. The RT product was heated at 95° C. for 2 min, followed by 10 cycles of heating at 95° C. for 30 sec, annealing at 55° C. for 30 sec and extending at 72° C. for 30 sec and a final extension step at 72° C. for 5 min. The PCR product was run on a 2.5% agarose gel and the appropriate band (~151 bp) was excised, gel purified and quantitated using a UV spectrophotometer (OD 260). Samples were combined at equal molar amounts and submitted for Illumina sequencing (Iowa State University DNA Facility, Ames, Iowa; Illumina Genome Analyzer II).

Illumina High-Throughput Sequencing Data Pre-Processing

The Illumina base calls were pre-processed and filtered to identify the variable region sequence as previously described (24, 48). These data (total sequences) included all variable region sequences, including replicates, for a given round of selection. The total sequences were collapsed to individual sequences with total associated reads for each individual sequence. These data (unique sequences) include the different variable region sequences for a given round and the read number (cluster size) associated with each sequence. The unique sequences and total sequences were then converted from DNA code to RNA code and the 5'/3' constant regions were added to give the full length RNA aptamer sequence. Table 4 summarizes the Illumina data obtained and the data filtered during pre-processing (Table 4).

Bioinformatics Analyses

Sequence Complexity and Sequence Enrichment

Sequence complexity was determined using the equation; sequence complexity=unique sequences/total sequences. Sequence enrichment was calculated by taking the complement of % sequence complexity using the equation; sequence enrichment=1−(unique sequences/total sequences). Unique sequences and total sequences refer to the data obtained during Illumina high-throughput sequencing data pre-processing.

Minimum Free Energy, Ensemble Free Energy, Ensemble Probability and Ensemble Diversity The set of unique sequences found within each round were analyzed with RNAfold (43, 62-64) (-T 30, -noLP, -noGU, -d2) from Vienna Package v2.0.0 (43, 44). A program (process_seqs_rnaFold) was created to allow for batch processing of sequences with RNAfold and included RNAfold data output in a comma delimited format. The average and SEM for minimum free energy (kcal/mol), ensemble free energy (kcal/mol), ensemble probability (Probability, %) and ensemble diversity (Diversity, #) were calculated. For the set of total sequences the averages and SEM were recalculated using the read number for each unique sequence.

Variable Region Length, Frequency of Sequences Between Rounds and Frequency of Cluster Sizes A non-redundant database was created of all unique sequences found within the rounds of selection (rounds 0, 1, 3, 5, 6, 7, 8). For each sequence, this database tracked the variable region nucleotide (nt) length (minimum=1 nt, maximum=56 nt), the number of rounds the sequence was identified in (minimum=1 round; maximum=7 rounds) and the read number (cluster size) of the sequence (minimum=1 read, maximum=956,532 reads). Using this database; the average, SEM, mode, maximum, minimum and frequency of the variable region nucleotide length was determined for each round; the frequency of the number of rounds sequences were found was determined for round 0 and rounds 1 through 8; the frequency of cluster sizes was determined for round 0 and rounds 1 through 8.

Sequence Families and Structure Families

A program (process.seqs) was created that used RNAfold and RNAdistance from the Vienna Package (v 2.0.0) (43, 44) to first predict the most likely structure and to second determine the edit/tree distance of all sequences/structures to each other. The program process.seqs filtered these data using a predefined limit on either edit distance (FIG. 8; data output for edit distance=1) or tree distance (FIG. 9; data output for tree distance=3). Process.seqs was run using increasing values of edit/tree distance to determine the maximum edit/tree distance where all sequences/structures connected. Clusters of sequences/structures interconnected at each edit/tree distance were determined and separated using the program Cytoscape (v 2.8.1). Using these data, a dendrogram of sequence/structure relatedness by edit/tree distance was created and the resulting dendrogram was evaluated using Cytoscape. The edit/tree distance dendrogram indicates the edit/tree distance that the unique sequences interconnect. Sequence/structure families were evaluated at each edit/tree distance using the multiple sequence alignment program ClustalX (v 2.1) or multiple RNA structure alignment program LocARNA (webserver).

Calculations for Rising, Fold Enrichment and Rate Enrichment

The previously described non-redundant database was used to normalize the read number of each sequence from a given round to the total reads from all rounds. To avoid dividing by 0 and simplify calculations, a read number of 1 was assumed with sequences with a read number of 0. The rising, fold enrichment and rate enrichment was determined for all unique sequence between rounds 1 through 3, 1 through 8, 3 through 8 and 6 through 8. 'Rising' was determined by calculating the correlation coefficient (−1.0 through 1.0) for each sequence using the read number and round number. Fold enrichment was determined by dividing the number of reads in a given rounds with the read number in a previous round. Rate enrichment was calculated by dividing the change in number of reads by the change in round number.

Plotting and Statistics

Data were plotted using either Microsoft Excel 2010 or GraphPad Prism 5. Average, SEM, mode and correlation were determined using Microsoft Excel 2010. Curve fitting was done using GraphPad Prism 5. Student's t-test was done using Microsoft Excel 2010 with significance set at a p value of <0.05. Correlation coefficients were determined using GraphPad Prism 5 by first determining normality and then the Spearman's correlation coefficient. Significance of the correlation coefficient was determined at a two-tailed p-value of <0.05.

Binding and Internalization Assay by Fluorescence of Fam-G Labeled RNA Aptamers

We used a modified version of the quantitative uptake method previously described (65). Fam-G labeled RNA was in vitro transcribed with the addition of 3 mM 6-FaM GTP (TriLink BioTechnologies) and purified using the same methods as previously described (24,66). Cells (A7r5 and YPEN-1) were prepared and blocked with tRNA as described for under the internalization assay by RT-qPCR methods. A "no RNA" control was included for each cell type to determine background fluorescence of the cell lysate. The Fam-G labeled RNA aptamers were folded in OPTI-MEM at 150 nM using the following modified RNA folding protocol; 98° C. for 10 min.; 65° C. for 15 min.; 37° C. for 20 min. The tRNA block was discarded and Fam-G labeled aptamers were added to cells for 30 minutes. Following RNA aptamer incubation, all samples, including the "no RNA" control, were washed 4× using one of two protocols to determine either binding or internalization. Washes for binding assay (no salt wash): 2× ice cold DPBS, 1× ice cold DPBS with 5 min. 4° C. incubation, 1× ice cold DPBS. Washes for internalization assay (salt wash): 1× ice cold DPBS, 1× ice cold 0.5M NaCl DPBS, 1× ice cold 0.5M NaCl DPBS with 5 min. 4° C. incubation, 1× ice cold DPBS. Following washes all samples had 600 uL 0.1M NaOH added to lyse cells. During lysis, the cell number control was collected and counted for each cell type as described previously. Cell lysate was collected using a cell scraper into 1.5 mL microcentrofuge tubes. Genomic DNA was sheared by sonication, level 2 for 10 seconds (Fisher Scientific Sonic Dimembrator Model 100). Insoluble protein was pelleted by centrifugation for 10 minutes at 10,000 g at room temperature. Lysate was aliquoted (100 uL) into a black 96-well plate (Nunc #237105) and fluorescence (LjL Bio-Sciences Analyst HT 96.384; Fluorescein Protocol: 1 mm depth, 485-20 excitation, 530-25 emission) of each sample was determined Fluorescence data was analyzed by subtracting background fluorescence measured from the "no RNA" control, normalizing to cell number, calculating the average and calculating the SEM.

TABLE 4

| | High-throughput sequencing data summary | | | | | |
|---|---|---|---|---|---|---|
| Round | Unfiltered (#) | Removed (#) | Filtered (%) | Total Reads (#) | Unique Reads (#) | Sequence Enrichment (%) |
| 0 | 285,103 | 5,775 | 2.03 | 279,328 | 278,929 | 0.14 |
| 0 | 528,852 | 11,405 | 2.16 | 517,447 | 516,475 | 0.19 |
| 1 | 366,528 | 8,856 | 2.42 | 357,672 | 353,246 | 1.24 |
| 3 | 286,540 | 7,016 | 2.45 | 279,524 | 224,842 | 19.56 |
| 5 | 319,642 | 6,806 | 2.13 | 312,836 | 33,259 | 89.37 |
| 6 | 321,715 | 6,940 | 2.16 | 314,775 | 8,264 | 97.37 |
| 7 | 260,986 | 6,330 | 2.43 | 254,656 | 6,836 | 97.32 |
| 8 | 235,673 | 5,141 | 2.18 | 230,532 | 4,113 | 98.22 |
| Total | 2,605,039 | 58,269 | 2.23 | 2,546,770 | 1,425,964 | |

REFERENCES

1. Thiel K W, Giangrande P H (2009) Therapeutic Applications of DNA and RNA Aptamers. Oligonucleotides 19: 209-222.
2. Keefe A D, Pai S, Ellington A (2010) Aptamers as therapeutics. Nat Rev Drug Discov 9: 537-550.
3. Tuerk C, Gold L (1990) Systematic evolution of ligands by exponential enrichment: RNA ligands to bacteriophage T4 DNA polymerase. Science 249: 505-510.
4. Ellington A D, Szostak J W (1990) In vitro selection of RNA molecules that bind specific ligands. Nature 346: 818-822.
5. Martell R E, Nevins J R, Sullenger B A (2002) Optimizing aptamer activity for gene therapy applications using expression cassette SELEX. Mol Ther 6: 30-34.
6. Giangrande P H, Zhang J, Tanner A, Eckhart A D, Rempel R E, et al. (2007) Distinct roles of E2F proteins in vascular smooth muscle cell proliferation and intimal hyperplasia. Proceedings of the National Academy of Sciences 104: 12988-12993.
7. Lebruska L L, Maher L J, 3rd (1999) Selection and characterization of an RNA decoy for transcription factor NF-kappa B. Biochemistry 38: 3168-3174.
8. Cho M, Xiao Y, Nie J, Stewart R, Csordas A T, et al. (2010) Quantitative selection of DNA aptamers through microfluidic selection and high-throughput sequencing. Proc Natl Acad Sci USA 107: 15373-15378.
9. Kubik M F, Bell C, Fitzwater T, Watson S R, Tasset D M (1997) Isolation and characterization of 2'-fluoro-, 2'-amino-, and 2'-fluoro-/amino-modified RNA ligands to human IFN-gamma that inhibit receptor binding. J Immunol 159: 259-267.
10. Jellinek D, Lynott C K, Rifkin D B, Janjic N (1993) High-affinity RNA ligands to basic fibroblast growth factor inhibit receptor binding. Proc Natl Acad Sci USA 90: 11227-11231.
11. Binkley J, Allen P, Brown D M, Green L, Tuerk C, et al. (1995) RNA ligands to human nerve growth factor. Nucleic Acids Res 23: 3198-3205.
12. Green L S, Jellinek D, Jenison R, Ostman A, Heldin C H, et al. (1996) Inhibitory DNA ligands to platelet-derived growth factor B-chain. Biochemistry 35: 14413-14424.
13. Rudman J, Green L S, Beeson J, Waugh S, Gillette W L, et al. (1998) 2'-Fluoropyrimidine RNA-based Aptamers to the 165-Amino Acid Form of Vascular Endothelial Growth Factor (VEGF165). Journal of Biological Chemistry 273: 20556-20567.
14. Fukuda K, Vishnuvardhan D, Sekiya S, Hwang J, Kakiuchi N, et al. (2000) Isolation and characterization of RNA aptamers specific for the hepatitis C virus nonstructural protein 3 protease. Eur J Biochem 267: 3685-3694.
15. Charlton J, Kirschenheuter G P, Smith D (1997) Highly potent irreversible inhibitors of neutrophil elastase generated by selection from a randomized DNA-valine phosphonate library. Biochemistry 36: 3018-3026.
16. Bock L C, Griffin L C, Latham J A, Vermaas E H, Toole J J (1992) Selection of single-stranded DNA molecules that bind and inhibit human thrombin. Nature 355: 564-566.
17. Rusconi C P, Scardino E, Layzer J, Pitoc G A, Ortel T L, et al. (2002) RNA aptamers as reversible antagonists of coagulation factor IXa. Nature 419: 90-94.
18. Ahmad K M, Oh S S, Kim S, McClellen F M, Xiao Y, et al. (2011) Probing the limits of aptamer affinity with a microfluidic SELEX platform. PLoS ONE 6: e27051.
19. Lupold S E, Hicke B J, Lin Y, Coffey D S (2002) Identification and Characterization of Nuclease-stabilized RNA Molecules That Bind Human Prostate Cancer Cells via the Prostate-specific Membrane Antigen. Cancer Research 62: 4029-4033.
20. Chen ChB (2003) Inhibition of heregulin signaling by an aptamer that preferentially binds to the oligomeric form of human epidermal growth factor receptor-3. Proceedings of the National Academy of Sciences 100: 9226-9231.
21. Cerchia L, Ducongé F, Pestourie C, Boulay J, Aissouni Y, et al. (2005) Neutralizing aptamers from whole-cell SELEX inhibit the RET receptor tyrosine kinase. PLoS Biol 3: e123.
22. Liu Y, Sun Q A, Chen Q, Lee T H, Huang Y, et al. (2009) Targeting inhibition of GluR1Ser845 phosphorylation with an RNA aptamer that blocks AMPA receptor trafficking. J Neurochem 108: 147-157.
23. Kraus E, James W, Barclay A N (1998) Cutting edge: novel RNA ligands able to bind CD4 antigen and inhibit CD4+ T lymphocyte function. J Immunol 160: 5209-5212.
24. Thiel K W, Hernandez L I, Dassie J P, Thiel W H, Liu X, et al. (2012) Delivery of chemo-sensitizing siRNAs to HER2+-breast cancer cells using RNA aptamers. Nucl Acids Res. 40(13):6319-37.
25. Theis M G, Knorre A, Kellersch B, Moelleken J, Wieland F, et al. (2004) Discriminatory aptamer reveals serum response element transcription regulated by cytohesin-2. Proc Natl Acad Sci USA 101: 11221-11226.
26. Mayer G, Blind M, Nagel W, Bohm T, Knorr T, et al. (2001) Controlling small guanine-nucleotide-exchange factor function through cytoplasmic RNA intramers. Proc Natl Acad Sci USA 98: 4961-4965.
27. Mi J, Zhang X, Giangrande P H, McNamara J O, 2nd, Nimjee S M, et al. (2005) Targeted inhibition of alphav- 28. Hicke B J, Marion C, Chang Y F, Gould T, Lynott C K, et al. (2001) Tenascin-C aptamers are generated using tumor cells and purified protein. J Biol Chem 276: 48644-48654.
29. Khati M, Schuman M, Ibrahim J, Sattentau Q, Gordon S, et al. (2003) Neutralization of infectivity of diverse R5 clinical isolates of human immunodeficiency virus type 1 by gp120-binding 2'F-RNA aptamers. J Virol 77: 12692-12698.
30. Giver L, Bartel D P, Zapp M L, Green M R, Ellington A D (1993) Selection and design of high-affinity RNA ligands for HIV-1 Rev. Gene 137: 19-24.
31. Allen P, Worland S, Gold L (1995) Isolation of high-affinity RNA ligands to HIV-1 integrase from a random pool. Virology 209: 327-336.
32. Blank M, Weinschenk T, Priemer M, Schluesener H (2001) Systematic evolution of a DNA aptamer binding to rat brain tumor microvessels. selective targeting of endothelial regulatory protein pigpen. J Biol Chem 276: 16464-16468.
33. Daniels D A, Chen H, Hicke B J, Swiderek K M, Gold L (2003) A tenascin-C aptamer identified by tumor cell SELEX: systematic evolution of ligands by exponential enrichment. Proc Natl Acad Sci USA 100: 15416-15421.
34. Shamah S M, Healy J M, Cload S T (2008) Complex Target SELEX. Accounts of Chemical Research 41: 130-138.
35. Sefah K, Tang Z W, Shangguan D H, Chen H, Lopez-Colon D, et al. (2009) Molecular recognition of acute myeloid leukemia using aptamers. Leukemia 23: 235-244.
36. Shangguan D, Meng L, Cao Z C, Xiao Z, Fang X, et al. (2008) Identification of liver cancer-specific aptamers using whole live cells. Anal Chem 80: 721-728.
37. Guo K T, Ziemer G, Paul A, Wendel H P (2008) CELL-SELEX: Novel perspectives of aptamer-based therapeutics. Int J Mol Sci 9: 668-678.
38. Morris K N, Jensen K B, Julin C M, Weil M, Gold L (1998) High affinity ligands from in vitro selection: complex targets. Proc Natl Acad Sci USA 95: 2902-2907.
39. Cerchia L, de Franciscis V (2010) Targeting cancer cells with nucleic acid aptamers. Trends Biotechnol 28: 517-525.
40. Meyer C, Hahn U, Rentmeister A (2011) Cell-specific aptamers as emerging therapeutics. J Nucleic Acids 2011: 904750.
41. Wullner U, Neef I, Eller A, Kleines M, Tur M K, et al. (2008) Cell-specific induction of apoptosis by rationally designed bivalent aptamer-siRNA transcripts silencing eukaryotic elongation factor 2. Curr Cancer Drug Targets 8: 554-565.
42. Schutze T, Arndt P F, Menger M, Wochner A, Vingron M, et al. (2010) A calibrated diversity assay for nucleic acid libraries using DiStRO—a Diversity Standard of Random Oligonucleotides. Nucleic Acids Res 38: e23.
43. Hofacker I L, Fontana W, Stadler P F, Bonhoeffer L S, Tacker M, et al. (1994) Fast folding and comparison of RNA secondary structures. Monatshefte für Chemie/Chemical Monthly 125: 167-188.
44. Lorenz R, Bernhart S H, Honer Zu Siederdissen C, Tafer H, Flamm C, et al. (2011) ViennaRNA Package 2.0. Algorithms Mol Biol 6: 26.
45. Berezhnoy A, Stewart C A, McNamara Ii J O, Thiel W, Giangrande P, et al. (2012) Isolation and Optimization of Murine IL-10 Receptor Blocking Oligonucleotide Aptamers Using High-throughput Sequencing. Mol. Ther.
46. Schutze T, Wilhelm B, Greiner N, Braun H, Peter F, et al. (2011) Probing the SELEX Process with Next-Generation Sequencing. PLoS ONE 6: e29604.
47. Zimmermann B, Gesell T, Chen D, Lorenz C, Schroeder Re (2010) Monitoring Genomic Sequences during SELEX Using High-Throughput Sequencing: Neutral SELEX. PLoS ONE 5: e9169.
48. Thiel W H, Bair T, Wyatt Thiel K, Dassie J P, Rockey W M, et al. (2011) Nucleotide bias observed with a short SELEX RNA aptamer library. Nucleic Acid Ther 21: 253-263.
49. Layzer J M, Sullenger B A (2007) Simultaneous generation of aptamers to multiple gamma-carboxyglutamic acid proteins from a focused aptamer library using DeSELEX and convergent selection. Oligonucleotides 17: 1-11.
50. Cerchia L, Esposito C L, Jacobs A H, Tavitian B, de Franciscis V (2009) Differential SELEX in human glioma cell lines. PLoS ONE 4: e7971.
51. Homann M, Goringer H U (1999) Combinatorial selection of high affinity RNA ligands to live African trypanosomes. Nucleic Acids Res 27: 2006-2014.
52. Chen F, Zhou J, Luo F, Mohammed A B, Zhang X L (2007) Aptamer from whole-bacterium SELEX as new therapeutic reagent against virulent *Mycobacterium tuberculosis*. Biochem Biophys Res Commun 357: 743-748.
53. Mi J, Liu Y, Rabbani Z N, Yang Z, Urban J H, et al. (2010) In vivo selection of tumor-targeting RNA motifs. Nat Chem Biol 6: 22-24.
54. Mallikaratchy P, Stahelin R V, Cao Z, Cho W, Tan W (2006) Selection of DNA ligands for protein kinase C-delta. Chem Commun (Camb): 3229-3231.
55. Li L, Li B, Qi Y, Jin Y (2009) Label-free aptamer-based colorimetric detection of mercury ions in aqueous media using unmodified gold nanoparticles as colorimetric probe. Anal Bioanal Chem 393: 2051-2057.
56. Mi Z, Guo H, Russell M B, Liu Y, Sullenger B A, et al. (2009) RNA aptamer blockade of osteopontin inhibits growth and metastasis of MDA-MB231 breast cancer cells. Mol Ther 17: 153-161.
57. Hernandez F J, Stockdale K R, Huang L, Horswill A R, Behlke M A, et al. (2012) Degradation of nuclease-stabilized RNA oligonucleotides in *Mycoplasma*-contaminated cell culture media. Nucleic Acid Ther 22: 58-68.
58. Huang Y, Eckstein F, Padilla R, Sousa R (1997) Mechanism of ribose 2'-group discrimination by an RNA polymerase. Biochemistry 36: 8231-8242.
59. Sousa R, Padilla R (1995) A mutant T7 RNA polymerase as a DNA polymerase. EMBO J. 14: 4609-4621.
60. Rockey W M, Hernandez F J, Huang S Y, Cao S, Howell C A, et al. (2011) Rational truncation of an RNA aptamer to prostate-specific membrane antigen using computational structural modeling. Nucleic Acid Ther 21: 299-314.
61. McNamara J O, Kolonias D, Pastor F, Mittler R S, Chen L, et al. (2008) Multivalent 4-1BB binding aptamers costimulate CD8+ T cells and inhibit tumor growth in mice. Journal of Clinical Investigation 118: 376-386.
62. Zuker M, Stiegler P (1981) Optimal computer folding of large RNA sequences using thermodynamics and auxiliary information. Nucleic Acids Res 9: 133-148.
63. McCaskill J S (1990) The equilibrium partition function and base pair binding probabilities for RNA secondary structure. Biopolymers 29: 1105-1119.
64. Bompfunewerer A F, Backofen R, Bernhart S H, Hertel J, Hofacker I L, et al. (2008) Variations on RNA folding and alignment: lessons from Benasque. J Math Biol 56: 129-144.

65. Lundberg P, El-Andaloussi S, Sutlu T, Johansson H, Langel U (2007) Delivery of short interfering RNA using endosomolytic cell-penetrating peptides. FASEB J 21: 2664-2671.
66. McNamara J O, Andrechek E R, Wang Y, Viles K D, Rempel R E, et al. (2006) Cell type-specific delivery of siRNAs with aptamer-siRNA chimeras. Nature Biotechnology 24: 1005-1015.

Example 2

It has now been shown that the aptamers selected on VSMCs in culture bind to rat and human vessel segments ex-vivo (FIGS. 14, 15 and 17). Several of the aptamers (01, 14 and 51) bind to denuded vessels (exposed smc layer) ex vivo (FIG. 16). Other figures show evaluating the functional effects of several of these aptamers on migration and proliferation of VSMCs (FIGS. 13, 18, 19). Effects of aptamer 14 and 01 were seen on inhibiting VSMC migration but not proliferation. These experiments were carried out in the present of two agonists (PDGF and TNFalpha) showing that the aptamers can inhibit multiple agonists and are probably affecting pathways downstream of the target receptor.

It was shown that aptamers are specific for vascular smooth muscle over muscle types (FIG. 20). Aptamers (150 nM) were incubated with tissue segments ex vivo for 30 min and recovered RNA measured by RT-qPCR. Data were normalized to tissue mass and expressed relative to denuded aorta.

The cross-reactivity of aptamers with human arterial segments and VSMCs was studied (FIG. 21). The amount of recovered RNA by RT-qPCR after incubation of aptamers (150 nM) for 30 min was measured on A) segments of human pulmonary artery (PPH=primary pulmonary hypertension; IPF=Idiopathic pulmonary fibrosis); or B) $1.25 \times 10^5$ cultured primary human aortic VSMCs (ATCC # PCS-100-012).

Although the foregoing specification and examples fully disclose and enable the present invention, they are not intended to limit the scope of the invention, which is defined by the claims appended hereto.

All publications, patents and patent applications are incorporated herein by reference. While in the foregoing specification this invention has been described in relation to certain embodiments thereof, and many details have been set forth for purposes of illustration, it will be apparent to those skilled in the art that the invention is susceptible to additional embodiments and that certain of the details described herein may be varied considerably without departing from the basic principles of the invention.

The use of the terms "a" and "an" and "the" and similar referents in the context of describing the invention are to be construed to cover both the singular and the plural, unless otherwise indicated herein or clearly contradicted by context. The terms "comprising," "having," "including," and "containing" are to be construed as open-ended terms (i.e., meaning "including, but not limited to") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (4633 sequences)

SEQ ID NO: 1 - DNA, 15 bp, Artificial Sequence
  Description of Artificial Sequence: Synthetic oligonucleotide
gggaggacgatgcgg

SEQ ID NO: 2 - DNA, 16 bp, Artificial Sequence
  Description of Artificial Sequence: Synthetic oligonucleotide
cagacgactcgcccga

SEQ ID NO: 3 - DNA, 51 bp, Artificial Sequence
  Description of Artificial Sequence: Synthetic oligonucleotide
  modified_base (17)..(36): a, c, t, g, unknown or other
tcgggcgagtcgtctgnnnnnnnnnnnnnnnnnnnnccgcatcgtcctccc

SEQ ID NO: 4 - DNA, 32 bp, Artificial Sequence
  Description of Artificial Sequence: Synthetic primer
taatacgactcactatagggaggacgatgcgg

SEQ ID NO: 5 - DNA, 16 bp, Artificial Sequence
  Description of Artificial Sequence: Synthetic primer
tcgggcgagtcgtctg

SEQ ID NO: 6 - DNA, 34 bp, Artificial Sequence
  Description of Artificial Sequence: Synthetic primer
ggggggatccagtactatcgacctctgggttatg

SEQ ID NO: 7 - DNA, 49 bp, Artificial Sequence
  Description of Artificial Sequence: Synthetic primer
gggggaattctaatacgactcactatagggagagaggaagagggatggg

SEQ ID NO: 8 - DNA, 81 bp, Artificial Sequence
  Description of Artificial Sequence: Synthetic primer
  modified_base (59)..(66): a, c, t, g, unknown or other
aatgatacggcgaccaccgagatctacactctttccctacacgacgctcttccgatctnnnnnnnngggaggacgatgcgg

SEQ ID NO: 9 - DNA, 50 bp, Artificial Sequence
  Description of Artificial Sequence: Synthetic primer
caagcagaagacggcatacgagctcttccgatcttcgggcgagtcgtctg

SEQ ID NO: 10 - DNA, 20 bp, Artificial Sequence
  Description of Artificial Sequence: Synthetic oligonucleotide
tcctgtcgtctgttcgtccc

SEQ ID NO: 11 - DNA, 21 bp, Artificial Sequence
  Description of Artificial Sequence: Synthetic oligonucleotide
gtcctgtcgtctgttcgtccc

SEQ ID NO: 12 - DNA, 20 bp, Artificial Sequence
  Description of Artificial Sequence: Synthetic oligonucleotide
ccctgtcgtctgttcgtccc

SEQ ID NO: 13 - DNA, 20 bp, Artificial Sequence
  Description of Artificial Sequence: Synthetic oligonucleotide
tcctggcttgtcgttgtccc

SEQ ID NO: 14 - DNA, 20 bp, Artificial Sequence
  Description of Artificial Sequence: Synthetic oligonucleotide
tcttgtcgtctgttcgtccc

SEQ ID NO: 15 - DNA, 20 bp, Artificial Sequence
  Description of Artificial Sequence: Synthetic oligonucleotide
tttggggttttcccgtgccc

SEQ ID NO: 16 - DNA, 20 bp, Artificial Sequence
  Description of Artificial Sequence: Synthetic oligonucleotide
tcctgtcgtctgttcgttcc

SEQ ID NO: 17 - DNA, 20 bp, Artificial Sequence
  Description of Artificial Sequence: Synthetic oligonucleotide
gcgtttcctctgttcgtccc

SEQ ID NO: 18 - DNA, 20 bp, Artificial Sequence
  Description of Artificial Sequence: Synthetic oligonucleotide
cgtttcctctggttcgtccc

SEQ ID NO: 19 - DNA, 20 bp, Artificial Sequence
  Description of Artificial Sequence: Synthetic oligonucleotide
tcctgtcgtctgttcgtttc

SEQ ID NO: 20 - DNA, 19 bp, Artificial Sequence
  Description of Artificial Sequence: Synthetic oligonucleotide
tcctgtcgtctgttcgtcc

SEQ ID NO: 21 - DNA, 20 bp, Artificial Sequence
  Description of Artificial Sequence: Synthetic oligonucleotide
tcctgtcgtctgctcgtccc

SEQ ID NO: 22 - DNA, 20 bp, Artificial Sequence
  Description of Artificial Sequence: Synthetic oligonucleotide
tgagtcgttcccttcgtccc

SEQ ID NO: 23 - DNA, 20 bp, Artificial Sequence
  Description of Artificial Sequence: Synthetic oligonucleotide
gcctttcgttctgacctccc

SEQ ID NO: 24 - DNA, 20 bp, Artificial Sequence
  Description of Artificial Sequence: Synthetic oligonucleotide
tgctgtcgtctgttcgtccc

SEQ ID NO: 25 - DNA, 20 bp, Artificial Sequence
  Description of Artificial Sequence: Synthetic oligonucleotide
tcctgtcgtctgtttgtccc

SEQ ID NO: 26 - DNA, 20 bp, Artificial Sequence
  Description of Artificial Sequence: Synthetic oligonucleotide
tcccgtcgtctgttcgtccc

SEQ ID NO: 27 - DNA, 20 bp, Artificial Sequence
  Description of Artificial Sequence: Synthetic oligonucleotide
tcctgtcgtctgttcctccc

SEQ ID NO: 28 - DNA, 19 bp, Artificial Sequence
  Description of Artificial Sequence: Synthetic oligonucleotide
cctgtcgtctgttcgtccc

SEQ ID NO: 29 - DNA, 20 bp, Artificial Sequence
  Description of Artificial Sequence: Synthetic oligonucleotide
tcctgtcgtctgtccgtccc

SEQ ID NO: 30 - DNA, 21 bp, Artificial Sequence
  Description of Artificial Sequence: Synthetic oligonucleotide
tttggggtttttcccgtgccc

SEQ ID NO: 31 - DNA, 20 bp, Artificial Sequence
  Description of Artificial Sequence: Synthetic oligonucleotide
gcttgtcttctgttcgtccc

SEQ ID NO: 32 - DNA, 19 bp, Artificial Sequence
  Description of Artificial Sequence: Synthetic oligonucleotide
tctgtgtgggatgtggccc

SEQ ID NO: 33 - DNA, 20 bp, Artificial Sequence
  Description of Artificial Sequence: Synthetic oligonucleotide
tcctgtcgtctgttcgcccc

SEQ ID NO: 34 - DNA, 19 bp, Artificial Sequence
  Description of Artificial Sequence: Synthetic oligonucleotide
tcctgtcgtctgtcgtccc

SEQ ID NO: 35 - DNA, 20 bp, Artificial Sequence
  Description of Artificial Sequence: Synthetic oligonucleotide
tcctgtcgtctcttcgtccc

SEQ ID NO: 36 - DNA, 20 bp, Artificial Sequence
  Description of Artificial Sequence: Synthetic oligonucleotide
tctcagtagtgggcctgctg

SEQ ID NO: 37 - DNA, 20 bp, Artificial Sequence
  Description of Artificial Sequence: Synthetic oligonucleotide
tcctgtcgcctgttcgtccc

SEQ ID NO: 38 - DNA, 21 bp, Artificial Sequence
  Description of Artificial Sequence: Synthetic oligonucleotide
tctgttgtgcttgatatgccc

SEQ ID NO: 39 - DNA, 20 bp, Artificial Sequence
  Description of Artificial Sequence: Synthetic oligonucleotide
tcctgtcgtcttttcgtccc

SEQ ID NO: 40 - DNA, 20 bp, Artificial Sequence
  Description of Artificial Sequence: Synthetic oligonucleotide
tcctgccgtctgttcgtccc

SEQ ID NO: 41 - DNA, 20 bp, Artificial Sequence
  Description of Artificial Sequence: Synthetic oligonucleotide
tcctgtcgtctgttcgtctc

SEQ ID NO: 42 - DNA, 20 bp, Artificial Sequence
  Description of Artificial Sequence: Synthetic oligonucleotide
tcctgtcgtctgttcgtacc

SEQ ID NO: 43 - DNA, 20 bp, Artificial Sequence
  Description of Artificial Sequence: Synthetic oligonucleotide
tcctgtcgtctgttcatccc

SEQ ID NO: 44 - DNA, 20 bp, Artificial Sequence
  Description of Artificial Sequence: Synthetic oligonucleotide
tcctgtcgtccgttcgtccc

SEQ ID NO: 45 - DNA, 20 bp, Artificial Sequence
  Description of Artificial Sequence: Synthetic oligonucleotide
gccttctcgtctgttgtccc

SEQ ID NO: 46 - DNA, 20 bp, Artificial Sequence
  Description of Artificial Sequence: Synthetic oligonucleotide
tcctgttgtctgttcgtccc

SEQ ID NO: 47 - DNA, 20 bp, Artificial Sequence
  Description of Artificial Sequence: Synthetic oligonucleotide
tcctgtcgtctgttcttccc

SEQ ID NO: 48 - DNA, 20 bp, Artificial Sequence
  Description of Artificial Sequence: Synthetic oligonucleotide
tcctgtcgtctattcgtccc

SEQ ID NO: 49 - DNA, 19 bp, Artificial Sequence
  Description of Artificial Sequence: Synthetic oligonucleotide
tcctgtcgtctgttgtccc

SEQ ID NO: 50 - DNA, 20 bp, Artificial Sequence
  Description of Artificial Sequence: Synthetic oligonucleotide
tgactcgtctgtttcgtccc

SEQ ID NO: 51 - DNA, 20 bp, Artificial Sequence
  Description of Artificial Sequence: Synthetic oligonucleotide
tcctgtcgtctgttcgtcct

SEQ ID NO: 52 - DNA, 20 bp, Artificial Sequence
  Description of Artificial Sequence: Synthetic oligonucleotide
tcctgtcgtttgttcgtccc

SEQ ID NO: 53 - DNA, 20 bp, Artificial Sequence
  Description of Artificial Sequence: Synthetic oligonucleotide
tcctgtcgtctgttcgtcca

SEQ ID NO: 54 - DNA, 20 bp, Artificial Sequence
  Description of Artificial Sequence: Synthetic oligonucleotide
tcctgtcatctgttcgtccc

SEQ ID NO: 55 - DNA, 20 bp, Artificial Sequence
  Description of Artificial Sequence: Synthetic oligonucleotide
tcctgtcgtctgttagtccc

SEQ ID NO: 56 - DNA, 20 bp, Artificial Sequence
  Description of Artificial Sequence: Synthetic oligonucleotide
tcctatcgtctgttcgtccc

SEQ ID NO: 57 - DNA, 20 bp, Artificial Sequence
  Description of Artificial Sequence: Synthetic oligonucleotide
tcctgtcgtctgtctgtccc

SEQ ID NO: 58 - DNA, 19 bp, Artificial Sequence
  Description of Artificial Sequence: Synthetic oligonucleotide
tcctgtcgtctgttcgttc

SEQ ID NO: 59 - DNA, 20 bp, Artificial Sequence
  Description of Artificial Sequence: Synthetic oligonucleotide
ttctgtcgtctgttcgtccc

SEQ ID NO: 60 - DNA, 20 bp, Artificial Sequence
  Description of Artificial Sequence: Synthetic oligonucleotide
tgtcgtagtctatccgcccg

SEQ ID NO: 61 - DNA, 20 bp, Artificial Sequence
  Description of Artificial Sequence: Synthetic oligonucleotide
tcctgtcgtctgatcgtccc

SEQ ID NO: 62 - DNA, 20 bp, Artificial Sequence
  Description of Artificial Sequence: Synthetic oligonucleotide
cgactcctctgttccctccc

SEQ ID NO: 63 - DNA, 20 bp, Artificial Sequence
  Description of Artificial Sequence: Synthetic oligonucleotide
gtcctgtcgtcttacgtccc

SEQ ID NO: 64 - DNA, 20 bp, Artificial Sequence
  Description of Artificial Sequence: Synthetic oligonucleotide
atgtatgttgggagccacgc

SEQ ID NO: 65 - DNA, 20 bp, Artificial Sequence
  Description of Artificial Sequence: Synthetic oligonucleotide
tccagtcgtctgttcgtccc

SEQ ID NO: 66 - DNA, 20 bp, Artificial Sequence
  Description of Artificial Sequence: Synthetic oligonucleotide
tcatgtcgtctgttcgtccc

SEQ ID NO: 67 - DNA, 19 bp, Artificial Sequence
  Description of Artificial Sequence: Synthetic oligonucleotide
gactgtatggggctctgtg

SEQ ID NO: 68 - DNA, 19 bp, Artificial Sequence
  Description of Artificial Sequence: Synthetic oligonucleotide
tcctgtcgtctttcgtccc

SEQ ID NO: 69 - DNA, 17 bp, Artificial Sequence
  Description of Artificial Sequence: Synthetic oligonucleotide
tcctgtcgtctgttccc

SEQ ID NO: 70 - DNA, 22 bp, Artificial Sequence
  Description of Artificial Sequence: Synthetic oligonucleotide
gccttctcgtctgttgtccccc

SEQ ID NO: 71 - DNA, 20 bp, Artificial Sequence
  Description of Artificial Sequence: Synthetic oligonucleotide
gccattcgtcttttcgtccc

SEQ ID NO: 72 - DNA, 20 bp, Artificial Sequence
  Description of Artificial Sequence: Synthetic oligonucleotide
tcctgtagtctgttcgtccc

SEQ ID NO: 73 - DNA, 21 bp, Artificial Sequence
  Description of Artificial Sequence: Synthetic oligonucleotide
tcctgtcgtctgtttcgtccc

SEQ ID NO: 74 - DNA, 20 bp, Artificial Sequence
  Description of Artificial Sequence: Synthetic oligonucleotide
cgaccttcgtctgcactccc

SEQ ID NO: 75 - DNA, 19 bp, Artificial Sequence
  Description of Artificial Sequence: Synthetic oligonucleotide
tcctgtcgtctgttctccc

SEQ ID NO: 76 - DNA, 20 bp, Artificial Sequence
  Description of Artificial Sequence: Synthetic oligonucleotide
tcctgtcgtatgttcgtccc

SEQ ID NO: 77 - DNA, 20 bp, Artificial Sequence
  Description of Artificial Sequence: Synthetic oligonucleotide
cgattcctctggttcgtccc

SEQ ID NO: 78 - DNA, 20 bp, Artificial Sequence
  Description of Artificial Sequence: Synthetic oligonucleotide
tcctgtcgtctgttggtccc

SEQ ID NO: 79 - DNA, 20 bp, Artificial Sequence
  Description of Artificial Sequence: Synthetic oligonucleotide
tcctgtcgtctgttcgtcac

SEQ ID NO: 80 - DNA, 20 bp, Artificial Sequence
  Description of Artificial Sequence: Synthetic oligonucleotide
ctgtctaccttctactgccg

SEQ ID NO: 81 - DNA, 20 bp, Artificial Sequence
  Description of Artificial Sequence: Synthetic oligonucleotide
acctgtcgtctgttcgtccc

SEQ ID NO: 82 - DNA, 17 bp, Artificial Sequence
  Description of Artificial Sequence: Synthetic oligonucleotide
tcctgtcgtctcgtccc

SEQ ID NO: 83 - DNA, 20 bp, Artificial Sequence
  Description of Artificial Sequence: Synthetic oligonucleotide
tcctgtcctctgttcgtccc

SEQ ID NO: 84 - DNA, 20 bp, Artificial Sequence
  Description of Artificial Sequence: Synthetic oligonucleotide
tcctctcgtctgttcgtccc

SEQ ID NO: 85 - DNA, 20 bp, Artificial Sequence
  Description of Artificial Sequence: Synthetic oligonucleotide
tcctgacgtctgttcgtccc

SEQ ID NO: 86 - DNA, 20 bp, Artificial Sequence
  Description of Artificial Sequence: Synthetic oligonucleotide
tcctgtcgtctgttcgtccg

SEQ ID NO: 87 - DNA, 20 bp, Artificial Sequence
  Description of Artificial Sequence: Synthetic oligonucleotide
tcctgtcgtctgttcgaccc

SEQ ID NO: 88 - DNA, 19 bp, Artificial Sequence
  Description of Artificial Sequence: Synthetic oligonucleotide
tctgtcgtctgttcgtccc

SEQ ID NO: 89 - DNA, 20 bp, Artificial Sequence
  Description of Artificial Sequence: Synthetic oligonucleotide
tcctgtcgtctgtacgtccc

SEQ ID NO: 90 - DNA, 20 bp, Artificial Sequence
  Description of Artificial Sequence: Synthetic oligonucleotide
tttggggtttcttcccgccc

SEQ ID NO: 91 - DNA, 21 bp, Artificial Sequence
  Description of Artificial Sequence: Synthetic oligonucleotide
tcctgtcgtctgttcgttccc

SEQ ID NO: 92 - DNA, 20 bp, Artificial Sequence
  Description of Artificial Sequence: Synthetic oligonucleotide
gccttcttctggttcgtccc

SEQ ID NO: 93 - DNA, 20 bp, Artificial Sequence
  Description of Artificial Sequence: Synthetic oligonucleotide
cgatgcttacgtgcacgcgc

SEQ ID NO: 94 - DNA, 20 bp, Artificial Sequence
  Description of Artificial Sequence: Synthetic oligonucleotide
gtgtttcgtctcttcgtccc

SEQ ID NO: 95 - DNA, 20 bp, Artificial Sequence
  Description of Artificial Sequence: Synthetic oligonucleotide
tcctgtcgtcagttcgtccc

SEQ ID NO: 96 - DNA, 19 bp, Artificial Sequence
  Description of Artificial Sequence: Synthetic oligonucleotide
tttggggtttcccgtgccc

SEQ ID NO: 97 - DNA, 20 bp, Artificial Sequence
  Description of Artificial Sequence: Synthetic oligonucleotide
ctgtatgttggtagccacgc

SEQ ID NO: 98 - DNA, 20 bp, Artificial Sequence
  Description of Artificial Sequence: Synthetic oligonucleotide
cgactcgatctgttcgtccc

SEQ ID NO: 99 - DNA, 20 bp, Artificial Sequence
  Description of Artificial Sequence: Synthetic oligonucleotide
tgcgtttcgtctcgcgtccc

SEQ ID NO: 100 - DNA, 20 bp, Artificial Sequence
  Description of Artificial Sequence: Synthetic oligonucleotide
tcctgtcgtctgttcggttc

SEQ ID NO: 101 - DNA, 20 bp, Artificial Sequence
  Description of Artificial Sequence: Synthetic oligonucleotide
ttgactcgtctgctgctccc

SEQ ID NO: 102 - DNA, 20 bp, Artificial Sequence
  Description of Artificial Sequence: Synthetic oligonucleotide
tcctgtcttctgttcgtccc

SEQ ID NO: 103 - DNA, 20 bp, Artificial Sequence
  Description of Artificial Sequence: Synthetic oligonucleotide
ccgactcgttctgcactccc

SEQ ID NO: 104 - DNA, 20 bp, Artificial Sequence
  Description of Artificial Sequence: Synthetic oligonucleotide
cgttcgtctgtttgggccgc

SEQ ID NO: 105 - DNA, 20 bp, Artificial Sequence
  Description of Artificial Sequence: Synthetic oligonucleotide
cctgtcgtctttttcgtccc

SEQ ID NO: 106 - DNA, 20 bp, Artificial Sequence
  Description of Artificial Sequence: Synthetic oligonucleotide
tactgtcgtctgttcgtccc

SEQ ID NO: 107 - DNA, 19 bp, Artificial Sequence
  Description of Artificial Sequence: Synthetic oligonucleotide
tccgtcgtctgttcgtccc

SEQ ID NO: 108 - DNA, 20 bp, Artificial Sequence
  Description of Artificial Sequence: Synthetic oligonucleotide
tcctttcgtctgttcgtccc

SEQ ID NO: 109 - DNA, 20 bp, Artificial Sequence
  Description of Artificial Sequence: Synthetic oligonucleotide
cgactcgttctgtccgtccc

SEQ ID NO: 110 - DNA, 22 bp, Artificial Sequence
  Description of Artificial Sequence: Synthetic oligonucleotide
tttggggttttttcccgtgccc

SEQ ID NO: 111 - DNA, 20 bp, Artificial Sequence
  Description of Artificial Sequence: Synthetic oligonucleotide
tcctgtcgtctgttcgtgcc

SEQ ID NO: 112 - DNA, 20 bp, Artificial Sequence
  Description of Artificial Sequence: Synthetic oligonucleotide
tgcctttcgtctgcactccc

SEQ ID NO: 113 - DNA, 20 bp, Artificial Sequence
  Description of Artificial Sequence: Synthetic oligonucleotide
tggtgtgtcaaggtacgcgc

SEQ ID NO: 114 - DNA, 20 bp, Artificial Sequence
  Description of Artificial Sequence: Synthetic oligonucleotide
tccggtcgtctgttcgtccc

SEQ ID NO: 115 - DNA, 18 bp, Artificial Sequence
  Description of Artificial Sequence: Synthetic oligonucleotide
gactgtacgggctctgtg

SEQ ID NO: 116 - DNA, 18 bp, Artificial Sequence
  Description of Artificial Sequence: Synthetic oligonucleotide
tcctgtcgtcttcgtccc

SEQ ID NO: 117 - DNA, 20 bp, Artificial Sequence
  Description of Artificial Sequence: Synthetic oligonucleotide
tcctgtcgtctggtcgtccc

SEQ ID NO: 118 - DNA, 20 bp, Artificial Sequence
  Description of Artificial Sequence: Synthetic oligonucleotide
tcctgtcgtctgttcgtcgc

SEQ ID NO: 119 - DNA, 20 bp, Artificial Sequence
  Description of Artificial Sequence: Synthetic oligonucleotide
gtgctctcgtctgcactccc

SEQ ID NO: 120 - DNA, 21 bp, Artificial Sequence
  Description of Artificial Sequence: Synthetic oligonucleotide
tcctgtcgtctgtctcgtccc

SEQ ID NO: 121 - DNA, 20 bp, Artificial Sequence
  Description of Artificial Sequence: Synthetic oligonucleotide
ccttgtcgtctgttcgtccc

SEQ ID NO: 122 - DNA, 20 bp, Artificial Sequence
  Description of Artificial Sequence: Synthetic oligonucleotide
cgagctcctctgttcgtccc

SEQ ID NO: 123 - DNA, 20 bp, Artificial Sequence
  Description of Artificial Sequence: Synthetic oligonucleotide
gcctttcgtttgttcgtccc

SEQ ID NO: 124 - DNA, 20 bp, Artificial Sequence
  Description of Artificial Sequence: Synthetic oligonucleotide
cctgtcgttctgttcgtccc

SEQ ID NO: 125 - DNA, 19 bp, Artificial Sequence
  Description of Artificial Sequence: Synthetic oligonucleotide
tcctgtcgtctgttccccc

SEQ ID NO: 126 - DNA, 21 bp, Artificial Sequence
  Description of Artificial Sequence: Synthetic oligonucleotide
tcgatcgtctgatttcgtccc

SEQ ID NO: 127 - DNA, 20 bp, Artificial Sequence
  Description of Artificial Sequence: Synthetic oligonucleotide
tcgtgtcgtctgttcgtccc

SEQ ID NO: 128 - DNA, 20 bp, Artificial Sequence
  Description of Artificial Sequence: Synthetic oligonucleotide
cgacctcgtctgttgctccc

SEQ ID NO: 129 - DNA, 20 bp, Artificial Sequence
  Description of Artificial Sequence: Synthetic oligonucleotide
tcctgtcgtgtgttcgtccc

SEQ ID NO: 130 - DNA, 20 bp, Artificial Sequence
  Description of Artificial Sequence: Synthetic oligonucleotide
cttgtcgtcttgttcgtccc

SEQ ID NO: 131 - DNA, 20 bp, Artificial Sequence
  Description of Artificial Sequence: Synthetic oligonucleotide
tcctgtcgactgttcgtccc

SEQ ID NO: 132 - DNA, 20 bp, Artificial Sequence
  Description of Artificial Sequence: Synthetic oligonucleotide
tcctgtcgtcggttcgtccc

SEQ ID NO: 133 - DNA, 20 bp, Artificial Sequence
  Description of Artificial Sequence: Synthetic oligonucleotide
gccttcgtcttgttcgtccc

SEQ ID NO: 134 - DNA, 19 bp, Artificial Sequence
  Description of Artificial Sequence: Synthetic oligonucleotide
tcctgtgtctgttcgtccc

SEQ ID NO: 135 - DNA, 18 bp, Artificial Sequence
  Description of Artificial Sequence: Synthetic oligonucleotide
tcctgtcgtctgttcccc

SEQ ID NO: 136 - DNA, 20 bp, Artificial Sequence
  Description of Artificial Sequence: Synthetic oligonucleotide
tcctgtcgtctgttcggccc

SEQ ID NO: 137 - DNA, 18 bp, Artificial Sequence
  Description of Artificial Sequence: Synthetic oligonucleotide
tcctgtcgtctgttcgtc

SEQ ID NO: 138 - DNA, 20 bp, Artificial Sequence
  Description of Artificial Sequence: Synthetic oligonucleotide
tgtgtcggtctgctgctccc

SEQ ID NO: 139 - DNA, 21 bp, Artificial Sequence
  Description of Artificial Sequence: Synthetic oligonucleotide
tcctgtcgtctgttcgtcccc

SEQ ID NO: 140 - DNA, 20 bp, Artificial Sequence
  Description of Artificial Sequence: Synthetic oligonucleotide
gcctctcgtctgcttctccc

SEQ ID NO: 141 - DNA, 21 bp, Artificial Sequence
  Description of Artificial Sequence: Synthetic oligonucleotide
gtgttcgtctgttttcgtccc

SEQ ID NO: 142 - DNA, 20 bp, Artificial Sequence
  Description of Artificial Sequence: Synthetic oligonucleotide
tcctgtcgtctcgtcgtccc

SEQ ID NO: 143 - DNA, 20 bp, Artificial Sequence
  Description of Artificial Sequence: Synthetic oligonucleotide
tgcgtctcgtctctgtcccc

SEQ ID NO: 144 - DNA, 21 bp, Artificial Sequence
  Description of Artificial Sequence: Synthetic oligonucleotide
tctgctgtgcttgatatgccc

SEQ ID NO: 145 - DNA, 21 bp, Artificial Sequence
  Description of Artificial Sequence: Synthetic oligonucleotide
gtgctcgtctgttttcgtccc

SEQ ID NO: 146 - DNA, 20 bp, Artificial Sequence
  Description of Artificial Sequence: Synthetic oligonucleotide
cgattcctctgtcccctccc

SEQ ID NO: 147 - DNA, 20 bp, Artificial Sequence
  Description of Artificial Sequence: Synthetic oligonucleotide
gccttttcgtcttgcctccc

SEQ ID NO: 148 - DNA, 19 bp, Artificial Sequence
  Description of Artificial Sequence: Synthetic oligonucleotide
tcctgtcgtctgctgtccc

SEQ ID NO: 149 - DNA, 20 bp, Artificial Sequence
  Description of Artificial Sequence: Synthetic oligonucleotide
gccttcgttctgagcctccc

SEQ ID NO: 150 - DNA, 20 bp, Artificial Sequence
  Description of Artificial Sequence: Synthetic oligonucleotide
tcctggcttgtcgttgttcc

SEQ ID NO: 151 - DNA, 20 bp, Artificial Sequence
  Description of Artificial Sequence: Synthetic oligonucleotide
cgactcctctgatccctccc

SEQ ID NO: 152 - DNA, 20 bp, Artificial Sequence
  Description of Artificial Sequence: Synthetic oligonucleotide
tcctgtcgtctgttcgtaca

SEQ ID NO: 153 - DNA, 20 bp, Artificial Sequence
  Description of Artificial Sequence: Synthetic oligonucleotide
tccagtcgttctgttgccgc

SEQ ID NO: 154 - DNA, 19 bp, Artificial Sequence
  Description of Artificial Sequence: Synthetic oligonucleotide
tcctgtcgtctctcgtccc

SEQ ID NO: 155 - DNA, 20 bp, Artificial Sequence
  Description of Artificial Sequence: Synthetic oligonucleotide
cttctcgtctgttccctccc

SEQ ID NO: 156 - DNA, 20 bp, Artificial Sequence
  Description of Artificial Sequence: Synthetic oligonucleotide
tcctgtcgtctggttgtccc

SEQ ID NO: 157 - DNA, 20 bp, Artificial Sequence
  Description of Artificial Sequence: Synthetic oligonucleotide
cgcttcaactggacctcccc

SEQ ID NO: 158 - DNA, 19 bp, Artificial Sequence
  Description of Artificial Sequence: Synthetic oligonucleotide
tcctgtcgtctgttcgccc

SEQ ID NO: 159 - DNA, 20 bp, Artificial Sequence
  Description of Artificial Sequence: Synthetic oligonucleotide
ccctgtcgtctgttcgttcc

SEQ ID NO: 160 - DNA, 20 bp, Artificial Sequence
  Description of Artificial Sequence: Synthetic oligonucleotide
gtgctcgtctgtttcgtccc

SEQ ID NO: 161 - DNA, 19 bp, Artificial Sequence
  Description of Artificial Sequence: Synthetic oligonucleotide
tcctgtcgtcgttcgtccc

SEQ ID NO: 162 - DNA, 20 bp, Artificial Sequence
  Description of Artificial Sequence: Synthetic oligonucleotide
tcctgtcggctgttcgtccc

SEQ ID NO: 163 - DNA, 20 bp, Artificial Sequence
  Description of Artificial Sequence: Synthetic oligonucleotide
tcctgtggtctgttcgtccc

SEQ ID NO: 164 - DNA, 20 bp, Artificial Sequence
  Description of Artificial Sequence: Synthetic oligonucleotide
cgcgtcttctgtttcgtccc

SEQ ID NO: 165 - DNA, 20 bp, Artificial Sequence
  Description of Artificial Sequence: Synthetic oligonucleotide
cgagcttctgatttcgtccc

SEQ ID NO: 166 - DNA, 21 bp, Artificial Sequence
  Description of Artificial Sequence: Synthetic oligonucleotide
gtcctgtcgtctgttcgttcc

SEQ ID NO: 167 - DNA, 18 bp, Artificial Sequence
  Description of Artificial Sequence: Synthetic oligonucleotide
tcctgtcgtctccgtccc

SEQ ID NO: 168 - DNA, 20 bp, Artificial Sequence
  Description of Artificial Sequence: Synthetic oligonucleotide
gcttctcgtctgaacctccc

SEQ ID NO: 169 - DNA, 20 bp, Artificial Sequence
  Description of Artificial Sequence: Synthetic oligonucleotide
atgtggtgtttgcttagctg

SEQ ID NO: 170 - DNA, 19 bp, Artificial Sequence
  Description of Artificial Sequence: Synthetic oligonucleotide
tcctgtcgtccgtcgtccc

SEQ ID NO: 171 - DNA, 20 bp, Artificial Sequence
  Description of Artificial Sequence: Synthetic oligonucleotide
cctttcgtctggttcgtccc

SEQ ID NO: 172 - DNA, 20 bp, Artificial Sequence
  Description of Artificial Sequence: Synthetic oligonucleotide
gccttcgtttggttcgtccc

SEQ ID NO: 173 - DNA, 20 bp, Artificial Sequence
  Description of Artificial Sequence: Synthetic oligonucleotide
gcctgtcttctgttcgtccc

SEQ ID NO: 174 - DNA, 20 bp, Artificial Sequence
  Description of Artificial Sequence: Synthetic oligonucleotide
gcctttcgtctgttcgtccc

SEQ ID NO: 175 - DNA, 20 bp, Artificial Sequence
  Description of Artificial Sequence: Synthetic oligonucleotide
gtctttcgtctgaacctccc

SEQ ID NO: 176 - DNA, 20 bp, Artificial Sequence
  Description of Artificial Sequence: Synthetic oligonucleotide
ccctgtcgtctgttcgtttc

SEQ ID NO: 177 - DNA, 20 bp, Artificial Sequence
  Description of Artificial Sequence: Synthetic oligonucleotide
cgtttcttctggttcgtccc

SEQ ID NO: 178 - DNA, 20 bp, Artificial Sequence
  Description of Artificial Sequence: Synthetic oligonucleotide
tctctgggtttgtgctgccc

SEQ ID NO: 179 - DNA, 20 bp, Artificial Sequence
  Description of Artificial Sequence: Synthetic oligonucleotide
tcctggcgtctgttcgtccc

SEQ ID NO: 180 - DNA, 20 bp, Artificial Sequence
  Description of Artificial Sequence: Synthetic oligonucleotide
tccagtcgtctttgcgtccc

SEQ ID NO: 181 - DNA, 18 bp, Artificial Sequence
  Description of Artificial Sequence: Synthetic oligonucleotide
gactgtatgggctctgtg

SEQ ID NO: 182 - DNA, 20 bp, Artificial Sequence
  Description of Artificial Sequence: Synthetic oligonucleotide
cgtctcgtctgacacctccc

SEQ ID NO: 183 - DNA, 21 bp, Artificial Sequence
  Description of Artificial Sequence: Synthetic oligonucleotide
tcctgtcgtctgttccgtccc

SEQ ID NO: 184 - DNA, 20 bp, Artificial Sequence
  Description of Artificial Sequence: Synthetic oligonucleotide
gactagcgatctgttacgca

SEQ ID NO: 185 - DNA, 20 bp, Artificial Sequence
  Description of Artificial Sequence: Synthetic oligonucleotide
cgctctcgtctgctactccc

SEQ ID NO: 186 - DNA, 20 bp, Artificial Sequence
  Description of Artificial Sequence: Synthetic oligonucleotide
gcgtttcctctgctgctccc

SEQ ID NO: 187 - DNA, 20 bp, Artificial Sequence
  Description of Artificial Sequence: Synthetic oligonucleotide
gtttgtcgtctcttcgtccc

SEQ ID NO: 188 - DNA, 20 bp, Artificial Sequence
  Description of Artificial Sequence: Synthetic oligonucleotide
tcctggcttgtcgttgcccc

SEQ ID NO: 189 - DNA, 20 bp, Artificial Sequence
  Description of Artificial Sequence: Synthetic oligonucleotide
cgcgactcctctgtactccc

SEQ ID NO: 190 - DNA, 20 bp, Artificial Sequence
  Description of Artificial Sequence: Synthetic oligonucleotide
gcttttcgtctctacgtccc

SEQ ID NO: 191 - DNA, 21 bp, Artificial Sequence
  Description of Artificial Sequence: Synthetic oligonucleotide
gtcctgtcgtctgctcgtccc

SEQ ID NO: 192 - DNA, 20 bp, Artificial Sequence
  Description of Artificial Sequence: Synthetic oligonucleotide
tcctgtcgtctgttcgtatc

SEQ ID NO: 193 - DNA, 20 bp, Artificial Sequence
  Description of Artificial Sequence: Synthetic oligonucleotide
ttgtctaccttctactgccg

SEQ ID NO: 194 - DNA, 20 bp, Artificial Sequence
  Description of Artificial Sequence: Synthetic oligonucleotide
cgatcgtctacactcgtccc

SEQ ID NO: 195 - DNA, 19 bp, Artificial Sequence
  Description of Artificial Sequence: Synthetic oligonucleotide
ccctgtcgtctgttcgtcc

SEQ ID NO: 196 - DNA, 20 bp, Artificial Sequence
  Description of Artificial Sequence: Synthetic oligonucleotide
cttctcgtctgtaccctccc

SEQ ID NO: 197 - DNA, 21 bp, Artificial Sequence
  Description of Artificial Sequence: Synthetic oligonucleotide
tgcctgtcgtctgttcgtccc

SEQ ID NO: 198 - DNA, 20 bp, Artificial Sequence
  Description of Artificial Sequence: Synthetic oligonucleotide
tttggggtttccccgtgccc

SEQ ID NO: 199 - DNA, 20 bp, Artificial Sequence
  Description of Artificial Sequence: Synthetic oligonucleotide
tttggggctttcccgtgccc

SEQ ID NO: 200 - DNA, 20 bp, Artificial Sequence
  Description of Artificial Sequence: Synthetic oligonucleotide
tcctggcctgtcgttgtccc

SEQ ID NO: 201 - DNA, 20 bp, Artificial Sequence
  Description of Artificial Sequence: Synthetic oligonucleotide
cgactcgttctgaccctccc

SEQ ID NO: 202 - DNA, 23 bp, Artificial Sequence
  Description of Artificial Sequence: Synthetic oligonucleotide
aattatgtgtttttttgtgaccg

SEQ ID NO: 203 - DNA, 20 bp, Artificial Sequence
  Description of Artificial Sequence: Synthetic oligonucleotide
tcctgtcgtctgttcgtctt

SEQ ID NO: 204 - DNA, 20 bp, Artificial Sequence
  Description of Artificial Sequence: Synthetic oligonucleotide
gactgtatcggggctctgtg

SEQ ID NO: 205 - DNA, 20 bp, Artificial Sequence
  Description of Artificial Sequence: Synthetic oligonucleotide
tcccggcttgtcgttgtccc

SEQ ID NO: 206 - DNA, 20 bp, Artificial Sequence
  Description of Artificial Sequence: Synthetic oligonucleotide
tcctgtcgtctgtgcgtccc

SEQ ID NO: 207 - DNA, 20 bp, Artificial Sequence
  Description of Artificial Sequence: Synthetic oligonucleotide
cgactctgtctgctgctccc

SEQ ID NO: 208 - DNA, 20 bp, Artificial Sequence
  Description of Artificial Sequence: Synthetic oligonucleotide
tcctggcttgtcgtcgtccc

SEQ ID NO: 209 - DNA, 20 bp, Artificial Sequence
  Description of Artificial Sequence: Synthetic oligonucleotide
tcttgtcgtctgttcgttcc

SEQ ID NO: 210 - DNA, 19 bp, Artificial Sequence
  Description of Artificial Sequence: Synthetic oligonucleotide
ttggggttttcccgtgccc

SEQ ID NO: 211 - DNA, 20 bp, Artificial Sequence
  Description of Artificial Sequence: Synthetic oligonucleotide
cgtctctcgtctgcactccc

SEQ ID NO: 212 - DNA, 20 bp, Artificial Sequence
  Description of Artificial Sequence: Synthetic oligonucleotide
gctcttcgtctttgcgtccc

SEQ ID NO: 213 - DNA, 20 bp, Artificial Sequence
  Description of Artificial Sequence: Synthetic oligonucleotide
tcgtctcgtctgttcgtccc

SEQ ID NO: 214 - DNA, 20 bp, Artificial Sequence
  Description of Artificial Sequence: Synthetic oligonucleotide
ccgattcgttctgccctccc

SEQ ID NO: 215 - DNA, 21 bp, Artificial Sequence
  Description of Artificial Sequence: Synthetic oligonucleotide
gccctgtcgtctgttcgtccc

SEQ ID NO: 216 - DNA, 21 bp, Artificial Sequence
  Description of Artificial Sequence: Synthetic oligonucleotide
gtcctgtcgtctgtttgtccc

SEQ ID NO: 217 - DNA, 20 bp, Artificial Sequence
  Description of Artificial Sequence: Synthetic oligonucleotide
tcctgtcgtctgttagtacc

SEQ ID NO: 218 - DNA, 20 bp, Artificial Sequence
  Description of Artificial Sequence: Synthetic oligonucleotide
tcgggtcctctgctactccc

SEQ ID NO: 219 - DNA, 20 bp, Artificial Sequence
  Description of Artificial Sequence: Synthetic oligonucleotide
cgattcctctggctcgtccc

SEQ ID NO: 220 - DNA, 20 bp, Artificial Sequence
  Description of Artificial Sequence: Synthetic oligonucleotide
ccctgtcgtctgtttgtccc

SEQ ID NO: 221 - DNA, 20 bp, Artificial Sequence
  Description of Artificial Sequence: Synthetic oligonucleotide
cgactcgatctgctcttccc

SEQ ID NO: 222 - DNA, 20 bp, Artificial Sequence
  Description of Artificial Sequence: Synthetic oligonucleotide
gcttgattcgtctacctccc

SEQ ID NO: 223 - DNA, 20 bp, Artificial Sequence
  Description of Artificial Sequence: Synthetic oligonucleotide
gtcctgtcgtctgtcgtccc

SEQ ID NO: 224 - DNA, 20 bp, Artificial Sequence
  Description of Artificial Sequence: Synthetic oligonucleotide
gtcctgtcgtctgttcgtcc

SEQ ID NO: 225 - DNA, 20 bp, Artificial Sequence
  Description of Artificial Sequence: Synthetic oligonucleotide
tcctgtagtctgttcgtacc

SEQ ID NO: 226 - DNA, 20 bp, Artificial Sequence
  Description of Artificial Sequence: Synthetic oligonucleotide
tttggggtcttcccgtgccc

SEQ ID NO: 227 - DNA, 19 bp, Artificial Sequence
  Description of Artificial Sequence: Synthetic oligonucleotide
gactgtacggggctctgtg

SEQ ID NO: 228 - DNA, 20 bp, Artificial Sequence
  Description of Artificial Sequence: Synthetic oligonucleotide
ccctgtcgtctgttcttccc

SEQ ID NO: 229 - DNA, 20 bp, Artificial Sequence
  Description of Artificial Sequence: Synthetic oligonucleotide
tttggggttttcctgcgccc

SEQ ID NO: 230 - DNA, 20 bp, Artificial Sequence
  Description of Artificial Sequence: Synthetic oligonucleotide
cgactcctctgtatgctccc

SEQ ID NO: 231 - DNA, 21 bp, Artificial Sequence
  Description of Artificial Sequence: Synthetic oligonucleotide
gtcccgtcgtctgttcgtccc

SEQ ID NO: 232 - DNA, 20 bp, Artificial Sequence
  Description of Artificial Sequence: Synthetic oligonucleotide
gtcagtcgtttgctcgtccc

SEQ ID NO: 233 - DNA, 21 bp, Artificial Sequence
  Description of Artificial Sequence: Synthetic oligonucleotide
gtcctgtcgcctgttcgtccc

SEQ ID NO: 234 - DNA, 21 bp, Artificial Sequence
  Description of Artificial Sequence: Synthetic oligonucleotide
gtcctgtcgtctgttcgcccc

SEQ ID NO: 235 - DNA, 20 bp, Artificial Sequence
  Description of Artificial Sequence: Synthetic oligonucleotide
tcgattcttctgctgctccc

SEQ ID NO: 236 - DNA, 20 bp, Artificial Sequence
  Description of Artificial Sequence: Synthetic oligonucleotide
tgagtcgttctcttcgtccc

SEQ ID NO: 237 - DNA, 19 bp, Artificial Sequence
  Description of Artificial Sequence: Synthetic oligonucleotide
tcctgtctctgttcgtccc

SEQ ID NO: 238 - DNA, 20 bp, Artificial Sequence
  Description of Artificial Sequence: Synthetic oligonucleotide
tttggggttttcccgtgccg

SEQ ID NO: 239 - DNA, 20 bp, Artificial Sequence
  Description of Artificial Sequence: Synthetic oligonucleotide
gcctttcgtctattcctccc

SEQ ID NO: 240 - DNA, 20 bp, Artificial Sequence
  Description of Artificial Sequence: Synthetic oligonucleotide
ccctgtcgtctgctcgtccc

SEQ ID NO: 241 - DNA, 20 bp, Artificial Sequence
  Description of Artificial Sequence: Synthetic oligonucleotide
ccctgtcgtctgttcctccc

SEQ ID NO: 242 - DNA, 20 bp, Artificial Sequence
  Description of Artificial Sequence: Synthetic oligonucleotide
tcttgtcgtctgctcgtccc

SEQ ID NO: 243 - DNA, 20 bp, Artificial Sequence
  Description of Artificial Sequence: Synthetic oligonucleotide
cgacctcgtctgaacctccc

SEQ ID NO: 244 - DNA, 20 bp, Artificial Sequence
  Description of Artificial Sequence: Synthetic oligonucleotide
gcccttcgtctgttcttccc

SEQ ID NO: 245 - DNA, 20 bp, Artificial Sequence
  Description of Artificial Sequence: Synthetic oligonucleotide
tcctgtcgtctttgcgtccc

SEQ ID NO: 246 - DNA, 20 bp, Artificial Sequence
  Description of Artificial Sequence: Synthetic oligonucleotide
tgcgtttcgtttgccctccc

SEQ ID NO: 247 - DNA, 20 bp, Artificial Sequence
  Description of Artificial Sequence: Synthetic oligonucleotide
tcctgtcgtatgttcgtacc

SEQ ID NO: 248 - DNA, 19 bp, Artificial Sequence
  Description of Artificial Sequence: Synthetic oligonucleotide
tcctgtcgttgttcgtccc

SEQ ID NO: 249 - DNA, 19 bp, Artificial Sequence
  Description of Artificial Sequence: Synthetic oligonucleotide
tttggggttttcccgtgcc

SEQ ID NO: 250 - DNA, 20 bp, Artificial Sequence
  Description of Artificial Sequence: Synthetic oligonucleotide
acctgtcgtctgttcgtacc

SEQ ID NO: 251 - DNA, 20 bp, Artificial Sequence
  Description of Artificial Sequence: Synthetic oligonucleotide
gcccttcgtctatgcctccc

SEQ ID NO: 252 - DNA, 20 bp, Artificial Sequence
  Description of Artificial Sequence: Synthetic oligonucleotide
tcatgtcgtctgttcgtacc

SEQ ID NO: 253 - DNA, 20 bp, Artificial Sequence
  Description of Artificial Sequence: Synthetic oligonucleotide
tcctgtcgtctgttcgtaac

SEQ ID NO: 254 - DNA, 17 bp, Artificial Sequence
  Description of Artificial Sequence: Synthetic oligonucleotide
tcctgtcgtcttgtccc

SEQ ID NO: 255 - DNA, 20 bp, Artificial Sequence
  Description of Artificial Sequence: Synthetic oligonucleotide
tcttgtcgtctgttcgtttc

SEQ ID NO: 256 - DNA, 20 bp, Artificial Sequence
  Description of Artificial Sequence: Synthetic oligonucleotide
cttggggttttcccgtgccc

SEQ ID NO: 257 - DNA, 21 bp, Artificial Sequence
  Description of Artificial Sequence: Synthetic oligonucleotide
gtcctgtcgtctattcgtccc

SEQ ID NO: 258 - DNA, 20 bp, Artificial Sequence
  Description of Artificial Sequence: Synthetic oligonucleotide
gtttctcgtctgctgctccc

SEQ ID NO: 259 - DNA, 20 bp, Artificial Sequence
  Description of Artificial Sequence: Synthetic oligonucleotide
tttggggttttcccgcgccc

SEQ ID NO: 260 - DNA, 20 bp, Artificial Sequence
  Description of Artificial Sequence: Synthetic oligonucleotide
ccctgtcgtctgttcgcccc

SEQ ID NO: 261 - DNA, 20 bp, Artificial Sequence
  Description of Artificial Sequence: Synthetic oligonucleotide
gccttcgtcttgtgcctccc

SEQ ID NO: 262 - DNA, 20 bp, Artificial Sequence
  Description of Artificial Sequence: Synthetic oligonucleotide
ggtttcgtctgtttcctccc

SEQ ID NO: 263 - DNA, 20 bp, Artificial Sequence
  Description of Artificial Sequence: Synthetic oligonucleotide
tcctgtcgtctgttagtcac

SEQ ID NO: 264 - DNA, 20 bp, Artificial Sequence
  Description of Artificial Sequence: Synthetic oligonucleotide
agcgtttcgtctgccctccc

SEQ ID NO: 265 - DNA, 21 bp, Artificial Sequence
  Description of Artificial Sequence: Synthetic oligonucleotide
gtcctgtcgtctgttcgtttc

SEQ ID NO: 266 - DNA, 20 bp, Artificial Sequence
  Description of Artificial Sequence: Synthetic oligonucleotide
tctcgtcgtctgttcgtccc

SEQ ID NO: 267 - DNA, 20 bp, Artificial Sequence
  Description of Artificial Sequence: Synthetic oligonucleotide
cgtttcctctggctcgtccc

SEQ ID NO: 268 - DNA, 20 bp, Artificial Sequence
  Description of Artificial Sequence: Synthetic oligonucleotide
gcctgtcgtctgttcgtccc

SEQ ID NO: 269 - DNA, 20 bp, Artificial Sequence
  Description of Artificial Sequence: Synthetic oligonucleotide
tcttgtcgtcttttcgtccc

SEQ ID NO: 270 - DNA, 20 bp, Artificial Sequence
  Description of Artificial Sequence: Synthetic oligonucleotide
gttcatgtttacctttcgtc

SEQ ID NO: 271 - DNA, 20 bp, Artificial Sequence
  Description of Artificial Sequence: Synthetic oligonucleotide
ccctgtcgcctgttcgtccc

SEQ ID NO: 272 - DNA, 20 bp, Artificial Sequence
  Description of Artificial Sequence: Synthetic oligonucleotide
cgaatcctctgctgtctccc

SEQ ID NO: 273 - DNA, 20 bp, Artificial Sequence
  Description of Artificial Sequence: Synthetic oligonucleotide
cgactcttctgcaacctccc

SEQ ID NO: 274 - DNA, 20 bp, Artificial Sequence
  Description of Artificial Sequence: Synthetic oligonucleotide
tcctggctcgtcgttgtccc

SEQ ID NO: 275 - DNA, 17 bp, Artificial Sequence
  Description of Artificial Sequence: Synthetic oligonucleotide
tcctggcttgttgtccc

SEQ ID NO: 276 - DNA, 20 bp, Artificial Sequence
  Description of Artificial Sequence: Synthetic oligonucleotide
gcttttcgtctctgcgtccc

SEQ ID NO: 277 - DNA, 21 bp, Artificial Sequence
  Description of Artificial Sequence: Synthetic oligonucleotide
gtcctgtcgtctgtccgtccc

SEQ ID NO: 278 - DNA, 19 bp, Artificial Sequence
  Description of Artificial Sequence: Synthetic oligonucleotide
tcttgtcgtctgttcgtcc

SEQ ID NO: 279 - DNA, 20 bp, Artificial Sequence
  Description of Artificial Sequence: Synthetic oligonucleotide
tttggggatttcctgcgccc

SEQ ID NO: 280 - DNA, 20 bp, Artificial Sequence
  Description of Artificial Sequence: Synthetic oligonucleotide
gatcatgctttcctttcgtc

SEQ ID NO: 281 - DNA, 20 bp, Artificial Sequence
  Description of Artificial Sequence: Synthetic oligonucleotide
ccctgtcgtctgtccgtccc

SEQ ID NO: 282 - DNA, 20 bp, Artificial Sequence
  Description of Artificial Sequence: Synthetic oligonucleotide
cctttcgtctgactgctccc

SEQ ID NO: 283 - DNA, 20 bp, Artificial Sequence
  Description of Artificial Sequence: Synthetic oligonucleotide
cgtctcgtcttttccctccc

SEQ ID NO: 284 - DNA, 21 bp, Artificial Sequence
  Description of Artificial Sequence: Synthetic oligonucleotide
gtcctgtcgtctcttcgtccc

SEQ ID NO: 285 - DNA, 20 bp, Artificial Sequence
  Description of Artificial Sequence: Synthetic oligonucleotide
tcggtcgtctctttcgtccc

SEQ ID NO: 286 - DNA, 20 bp, Artificial Sequence
  Description of Artificial Sequence: Synthetic oligonucleotide
tcttctgggtttggccgccc

SEQ ID NO: 287 - DNA, 20 bp, Artificial Sequence
  Description of Artificial Sequence: Synthetic oligonucleotide
gttggggttttcccgtgccc

SEQ ID NO: 288 - DNA, 20 bp, Artificial Sequence
  Description of Artificial Sequence: Synthetic oligonucleotide
ccagtcgtctatttcgtccc

SEQ ID NO: 289 - DNA, 20 bp, Artificial Sequence
  Description of Artificial Sequence: Synthetic oligonucleotide
cgatcgttctgctacctccc

SEQ ID NO: 290 - DNA, 20 bp, Artificial Sequence
  Description of Artificial Sequence: Synthetic oligonucleotide
ggtttcgtctgactcgtccc

SEQ ID NO: 291 - DNA, 20 bp, Artificial Sequence
  Description of Artificial Sequence: Synthetic oligonucleotide
gtcgactcgtttgcgctccc

SEQ ID NO: 292 - DNA, 20 bp, Artificial Sequence
  Description of Artificial Sequence: Synthetic oligonucleotide
tcctgtcgtctgttagtcca

SEQ ID NO: 293 - DNA, 22 bp, Artificial Sequence
  Description of Artificial Sequence: Synthetic oligonucleotide
tcctgtcgtctgttttcgtccc

SEQ ID NO: 294 - DNA, 20 bp, Artificial Sequence
  Description of Artificial Sequence: Synthetic oligonucleotide
tttggggttctcccgtgccc

SEQ ID NO: 295 - DNA, 20 bp, Artificial Sequence
  Description of Artificial Sequence: Synthetic oligonucleotide
tttggggtttttccgtgccc

SEQ ID NO: 296 - DNA, 20 bp, Artificial Sequence
  Description of Artificial Sequence: Synthetic oligonucleotide
ccttcgtctggtttcgtccc

SEQ ID NO: 297 - DNA, 21 bp, Artificial Sequence
  Description of Artificial Sequence: Synthetic oligonucleotide
gtcctgccgtctgttcgtccc

SEQ ID NO: 298 - DNA, 21 bp, Artificial Sequence
  Description of Artificial Sequence: Synthetic oligonucleotide
gtcctgtcgtccgttcgtccc

SEQ ID NO: 299 - DNA, 18 bp, Artificial Sequence
  Description of Artificial Sequence: Synthetic oligonucleotide
tcctgtcgtctctgtccc

SEQ ID NO: 300 - DNA, 18 bp, Artificial Sequence
  Description of Artificial Sequence: Synthetic oligonucleotide
ttgtcgtctgttcgtccc

SEQ ID NO: 301 - DNA, 20 bp, Artificial Sequence
  Description of Artificial Sequence: Synthetic oligonucleotide
tttggggatttcctcggccc

SEQ ID NO: 302 - DNA, 20 bp, Artificial Sequence
  Description of Artificial Sequence: Synthetic oligonucleotide
gccttcttctggagcctccc

SEQ ID NO: 303 - DNA, 21 bp, Artificial Sequence
  Description of Artificial Sequence: Synthetic oligonucleotide
gtcctgtcgtttgttcgtccc

SEQ ID NO: 304 - DNA, 20 bp, Artificial Sequence
  Description of Artificial Sequence: Synthetic oligonucleotide
tcctgtcgtatgttagtccc

SEQ ID NO: 305 - DNA, 20 bp, Artificial Sequence
  Description of Artificial Sequence: Synthetic oligonucleotide
tcggttcgttctgcgctccc

SEQ ID NO: 306 - DNA, 19 bp, Artificial Sequence
  Description of Artificial Sequence: Synthetic oligonucleotide
tttggggttttccctgccc

SEQ ID NO: 307 - DNA, 20 bp, Artificial Sequence
  Description of Artificial Sequence: Synthetic oligonucleotide
ccgactcgtctgctactccc

SEQ ID NO: 308 - DNA, 20 bp, Artificial Sequence
  Description of Artificial Sequence: Synthetic oligonucleotide
cgcttttcgtctgacctccc

SEQ ID NO: 309 - DNA, 20 bp, Artificial Sequence
  Description of Artificial Sequence: Synthetic oligonucleotide
gccattcgtttgttcgtccc

SEQ ID NO: 310 - DNA, 20 bp, Artificial Sequence
  Description of Artificial Sequence: Synthetic oligonucleotide
gcccttcgttctgaactccc

SEQ ID NO: 311 - DNA, 20 bp, Artificial Sequence
  Description of Artificial Sequence: Synthetic oligonucleotide
gcctgtcctctgttcgtccc

SEQ ID NO: 312 - DNA, 20 bp, Artificial Sequence
  Description of Artificial Sequence: Synthetic oligonucleotide
gcgtttcctctgttcgttcc

SEQ ID NO: 313 - DNA, 20 bp, Artificial Sequence
  Description of Artificial Sequence: Synthetic oligonucleotide
gcttttcgttctgacctccc

SEQ ID NO: 314 - DNA, 20 bp, Artificial Sequence
  Description of Artificial Sequence: Synthetic oligonucleotide
gtcagttcgtctgcactccc

SEQ ID NO: 315 - DNA, 20 bp, Artificial Sequence
  Description of Artificial Sequence: Synthetic oligonucleotide
gtcctgtcgtctgttgtccc

SEQ ID NO: 316 - DNA, 20 bp, Artificial Sequence
  Description of Artificial Sequence: Synthetic oligonucleotide
tcctgtagtatgttcgtccc

SEQ ID NO: 317 - DNA, 20 bp, Artificial Sequence
  Description of Artificial Sequence: Synthetic oligonucleotide
tcgtttgggatttcccgccc

SEQ ID NO: 318 - DNA, 20 bp, Artificial Sequence
  Description of Artificial Sequence: Synthetic oligonucleotide
tcttgtcgtctgtttgtccc

SEQ ID NO: 319 - DNA, 20 bp, Artificial Sequence
  Description of Artificial Sequence: Synthetic oligonucleotide
tcttgttcgtctgcactccc

SEQ ID NO: 320 - DNA, 20 bp, Artificial Sequence
  Description of Artificial Sequence: Synthetic oligonucleotide
tttggggttattccctgccc

SEQ ID NO: 321 - DNA, 20 bp, Artificial Sequence
  Description of Artificial Sequence: Synthetic oligonucleotide
ccccgtcgtctgttcgtccc

SEQ ID NO: 322 - DNA, 20 bp, Artificial Sequence
  Description of Artificial Sequence: Synthetic oligonucleotide
ccctgtcatctgttcgtccc

SEQ ID NO: 323 - DNA, 20 bp, Artificial Sequence
  Description of Artificial Sequence: Synthetic oligonucleotide
ccgagatcctctgtactccc

SEQ ID NO: 324 - DNA, 20 bp, Artificial Sequence
  Description of Artificial Sequence: Synthetic oligonucleotide
ccttcgtctggattcgtccc

SEQ ID NO: 325 - DNA, 20 bp, Artificial Sequence
  Description of Artificial Sequence: Synthetic oligonucleotide
cgtgtctcgtctgcactccc

SEQ ID NO: 326 - DNA, 20 bp, Artificial Sequence
  Description of Artificial Sequence: Synthetic oligonucleotide
cgtttcgtctgtcacctccc

SEQ ID NO: 327 - DNA, 20 bp, Artificial Sequence
  Description of Artificial Sequence: Synthetic oligonucleotide
gccttctcgtctgactcccc

SEQ ID NO: 328 - DNA, 20 bp, Artificial Sequence
  Description of Artificial Sequence: Synthetic oligonucleotide
gccttctcgtctgatccccc

SEQ ID NO: 329 - DNA, 17 bp, Artificial Sequence
  Description of Artificial Sequence: Synthetic oligonucleotide
gtcctgtcgtctgtccc

SEQ ID NO: 330 - DNA, 21 bp, Artificial Sequence
  Description of Artificial Sequence: Synthetic oligonucleotide
gtcctgtcgtctgttcatccc

SEQ ID NO: 331 - DNA, 20 bp, Artificial Sequence
  Description of Artificial Sequence: Synthetic oligonucleotide
tactgtcgtctgttcgtacc

SEQ ID NO: 332 - DNA, 20 bp, Artificial Sequence
  Description of Artificial Sequence: Synthetic oligonucleotide
tcatgtcgtctgttcgtcca

SEQ ID NO: 333 - DNA, 20 bp, Artificial Sequence
  Description of Artificial Sequence: Synthetic oligonucleotide
tcctggcttgtcgttgtttc

SEQ ID NO: 334 - DNA, 19 bp, Artificial Sequence
  Description of Artificial Sequence: Synthetic oligonucleotide
tcctgtcgtctatcgtccc

SEQ ID NO: 335 - DNA, 20 bp, Artificial Sequence
  Description of Artificial Sequence: Synthetic oligonucleotide
tcctgtcgtctgctcgttcc

SEQ ID NO: 336 - DNA, 19 bp, Artificial Sequence
  Description of Artificial Sequence: Synthetic oligonucleotide
tcctgtcgtctgttcttcc

SEQ ID NO: 337 - DNA, 20 bp, Artificial Sequence
  Description of Artificial Sequence: Synthetic oligonucleotide
ttttgtcgtctgttcgtccc

SEQ ID NO: 338 - DNA, 20 bp, Artificial Sequence
  Description of Artificial Sequence: Synthetic oligonucleotide
ccctgtcgtccgttcgtccc

SEQ ID NO: 339 - DNA, 20 bp, Artificial Sequence
  Description of Artificial Sequence: Synthetic oligonucleotide
ccctgtcgtctgttcgtctc

SEQ ID NO: 340 - DNA, 20 bp, Artificial Sequence
  Description of Artificial Sequence: Synthetic oligonucleotide
cgtatttcgtctgcgctccc

SEQ ID NO: 341 - DNA, 20 bp, Artificial Sequence
  Description of Artificial Sequence: Synthetic oligonucleotide
cgtctttcgtctgtggtccc

SEQ ID NO: 342 - DNA, 20 bp, Artificial Sequence
  Description of Artificial Sequence: Synthetic oligonucleotide
cgtttttcgtctgagctccc

SEQ ID NO: 343 - DNA, 20 bp, Artificial Sequence
  Description of Artificial Sequence: Synthetic oligonucleotide
gcgtttcgtttcctcgtccc

SEQ ID NO: 344 - DNA, 21 bp, Artificial Sequence
  Description of Artificial Sequence: Synthetic oligonucleotide
gtcctgttgtctgttcgtccc

SEQ ID NO: 345 - DNA, 20 bp, Artificial Sequence
  Description of Artificial Sequence: Synthetic oligonucleotide
tcctgtagtctgttagtccc

SEQ ID NO: 346 - DNA, 20 bp, Artificial Sequence
  Description of Artificial Sequence: Synthetic oligonucleotide
tcgttgtcttctgcgctccc

SEQ ID NO: 347 - DNA, 23 bp, Artificial Sequence
  Description of Artificial Sequence: Synthetic oligonucleotide
tttggggtttttttcccgtgccc

SEQ ID NO: 348 - DNA, 20 bp, Artificial Sequence
  Description of Artificial Sequence: Synthetic oligonucleotide
cgtcactcgtctgtactccc

SEQ ID NO: 349 - DNA, 21 bp, Artificial Sequence
  Description of Artificial Sequence: Synthetic oligonucleotide
gtcctgtcgtctgttcttccc

SEQ ID NO: 350 - DNA, 20 bp, Artificial Sequence
  Description of Artificial Sequence: Synthetic oligonucleotide
tcctggcttgtcgttttccc

SEQ ID NO: 351 - DNA, 20 bp, Artificial Sequence
  Description of Artificial Sequence: Synthetic oligonucleotide
tcctgtcgtatgttcgtcca

SEQ ID NO: 352 - DNA, 21 bp, Artificial Sequence
  Description of Artificial Sequence: Synthetic oligonucleotide
tcctgtcgtctgttccctccc

SEQ ID NO: 353 - DNA, 20 bp, Artificial Sequence
  Description of Artificial Sequence: Synthetic oligonucleotide
tgtgatcgtctgcacctccc

SEQ ID NO: 354 - DNA, 20 bp, Artificial Sequence
  Description of Artificial Sequence: Synthetic oligonucleotide
ccagtcgttctgtccctccc

SEQ ID NO: 355 - DNA, 19 bp, Artificial Sequence
  Description of Artificial Sequence: Synthetic oligonucleotide
tcctggcttgtcgttgtcc

SEQ ID NO: 356 - DNA, 20 bp, Artificial Sequence
  Description of Artificial Sequence: Synthetic oligonucleotide
ccctgtcgtctgttcatccc

SEQ ID NO: 357 - DNA, 20 bp, Artificial Sequence
  Description of Artificial Sequence: Synthetic oligonucleotide
ccgatcgttctgtgcctccc

SEQ ID NO: 358 - DNA, 20 bp, Artificial Sequence
  Description of Artificial Sequence: Synthetic oligonucleotide
ctacactcaaatgagggccg

SEQ ID NO: 359 - DNA, 20 bp, Artificial Sequence
  Description of Artificial Sequence: Synthetic oligonucleotide
ctctgtcgtctgttcgtccc

SEQ ID NO: 360 - DNA, 21 bp, Artificial Sequence
  Description of Artificial Sequence: Synthetic oligonucleotide
gccttctcgtctgttcgtccc

SEQ ID NO: 361 - DNA, 20 bp, Artificial Sequence
  Description of Artificial Sequence: Synthetic oligonucleotide
tcctggcttgtcgctgtccc

SEQ ID NO: 362 - DNA, 19 bp, Artificial Sequence
  Description of Artificial Sequence: Synthetic oligonucleotide
tcctggcttgtcgtttccc

SEQ ID NO: 363 - DNA, 20 bp, Artificial Sequence
  Description of Artificial Sequence: Synthetic oligonucleotide
tcctgtagtctgttcgtcca

SEQ ID NO: 364 - DNA, 20 bp, Artificial Sequence
  Description of Artificial Sequence: Synthetic oligonucleotide
tcctgtcgtctgtttgttcc

SEQ ID NO: 365 - DNA, 20 bp, Artificial Sequence
  Description of Artificial Sequence: Synthetic oligonucleotide
tgactcgtctgcgccttccc

SEQ ID NO: 366 - DNA, 20 bp, Artificial Sequence
  Description of Artificial Sequence: Synthetic oligonucleotide
ccagtcgtcttgttcgtccc

SEQ ID NO: 367 - DNA, 20 bp, Artificial Sequence
  Description of Artificial Sequence: Synthetic oligonucleotide
ccagtcttctgttacctccc

SEQ ID NO: 368 - DNA, 20 bp, Artificial Sequence
  Description of Artificial Sequence: Synthetic oligonucleotide
cgtttcctctggttcgttcc

SEQ ID NO: 369 - DNA, 18 bp, Artificial Sequence
  Description of Artificial Sequence: Synthetic oligonucleotide
tcctggcttgtcgttccc

SEQ ID NO: 370 - DNA, 20 bp, Artificial Sequence
  Description of Artificial Sequence: Synthetic oligonucleotide
tcctggcttgtcgttgtacc

SEQ ID NO: 371 - DNA, 20 bp, Artificial Sequence
  Description of Artificial Sequence: Synthetic oligonucleotide
tcctggcttgttgttgtccc

SEQ ID NO: 372 - DNA, 20 bp, Artificial Sequence
  Description of Artificial Sequence: Synthetic oligonucleotide
tcgattcgtctccgcgtccc

SEQ ID NO: 373 - DNA, 20 bp, Artificial Sequence
  Description of Artificial Sequence: Synthetic oligonucleotide
tgggtcctctgttgcctccc

SEQ ID NO: 374 - DNA, 20 bp, Artificial Sequence
  Description of Artificial Sequence: Synthetic oligonucleotide
tttgggggtttcccgtgccc

SEQ ID NO: 375 - DNA, 20 bp, Artificial Sequence
  Description of Artificial Sequence: Synthetic oligonucleotide
tttggggttttctcgtgccc

SEQ ID NO: 376 - DNA, 20 bp, Artificial Sequence
  Description of Artificial Sequence: Synthetic oligonucleotide
ccctgccgtctgttcgtccc

SEQ ID NO: 377 - DNA, 20 bp, Artificial Sequence
  Description of Artificial Sequence: Synthetic oligonucleotide
cgactcgtgctgttcttccc

SEQ ID NO: 378 - DNA, 20 bp, Artificial Sequence
  Description of Artificial Sequence: Synthetic oligonucleotide
cgcctcgtctgtttcctccc

SEQ ID NO: 379 - DNA, 20 bp, Artificial Sequence
  Description of Artificial Sequence: Synthetic oligonucleotide
gagtttcgtctgagcctccc

SEQ ID NO: 380 - DNA, 20 bp, Artificial Sequence
  Description of Artificial Sequence: Synthetic oligonucleotide
gtcaatcgtctgcgcctccc

SEQ ID NO: 381 - DNA, 21 bp, Artificial Sequence
  Description of Artificial Sequence: Synthetic oligonucleotide
gtcctgtcgtctgttcgtcct

SEQ ID NO: 382 - DNA, 20 bp, Artificial Sequence
  Description of Artificial Sequence: Synthetic oligonucleotide
gtgtctcgtctgtcactccc

SEQ ID NO: 383 - DNA, 21 bp, Artificial Sequence
  Description of Artificial Sequence: Synthetic oligonucleotide
gtgtttcctctggttcgtccc

SEQ ID NO: 384 - DNA, 20 bp, Artificial Sequence
  Description of Artificial Sequence: Synthetic oligonucleotide
tcctggcttgtcgttgtctc

SEQ ID NO: 385 - DNA, 20 bp, Artificial Sequence
  Description of Artificial Sequence: Synthetic oligonucleotide
tcctgtagtctgttcgtcac

SEQ ID NO: 386 - DNA, 20 bp, Artificial Sequence
  Description of Artificial Sequence: Synthetic oligonucleotide
tcctgtcgtctgttcgtcaa

SEQ ID NO: 387 - DNA, 20 bp, Artificial Sequence
  Description of Artificial Sequence: Synthetic oligonucleotide
tcctgtcgtctgtttctccc

SEQ ID NO: 388 - DNA, 21 bp, Artificial Sequence
  Description of Artificial Sequence: Synthetic oligonucleotide
atcctgtcgtctgttcgtccc

SEQ ID NO: 389 - DNA, 20 bp, Artificial Sequence
  Description of Artificial Sequence: Synthetic oligonucleotide
cgactcctctgctgcttccc

SEQ ID NO: 390 - DNA, 20 bp, Artificial Sequence
  Description of Artificial Sequence: Synthetic oligonucleotide
gcactcgttctgaccctccc

SEQ ID NO: 391 - DNA, 21 bp, Artificial Sequence
  Description of Artificial Sequence: Synthetic oligonucleotide
gtcctgtcgtctgttcctccc

SEQ ID NO: 392 - DNA, 21 bp, Artificial Sequence
  Description of Artificial Sequence: Synthetic oligonucleotide
gtcctgtcgtcttttcgtccc

SEQ ID NO: 393 - DNA, 19 bp, Artificial Sequence
  Description of Artificial Sequence: Synthetic oligonucleotide
tcctggctgtcgttgtccc

SEQ ID NO: 394 - DNA, 21 bp, Artificial Sequence
  Description of Artificial Sequence: Synthetic oligonucleotide
tcctgtcgtctgattcgtccc

SEQ ID NO: 395 - DNA, 19 bp, Artificial Sequence
  Description of Artificial Sequence: Synthetic oligonucleotide
tcctgtcgtctgctcgtcc

SEQ ID NO: 396 - DNA, 18 bp, Artificial Sequence
  Description of Artificial Sequence: Synthetic oligonucleotide
tcctgtcgtctgtccccc

SEQ ID NO: 397 - DNA, 21 bp, Artificial Sequence
  Description of Artificial Sequence: Synthetic oligonucleotide
tcctgtcgttctgttcgtccc

SEQ ID NO: 398 - DNA, 20 bp, Artificial Sequence
  Description of Artificial Sequence: Synthetic oligonucleotide
tctggggttttcccgtgccc

SEQ ID NO: 399 - DNA, 20 bp, Artificial Sequence
  Description of Artificial Sequence: Synthetic oligonucleotide
tttggggttttcccatgccc

SEQ ID NO: 400 - DNA, 20 bp, Artificial Sequence
  Description of Artificial Sequence: Synthetic oligonucleotide
tttggggttttcccgtgacc

SEQ ID NO: 401 - DNA, 19 bp, Artificial Sequence
  Description of Artificial Sequence: Synthetic oligonucleotide
cccgtcgtctgttcgtccc

SEQ ID NO: 402 - DNA, 20 bp, Artificial Sequence
  Description of Artificial Sequence: Synthetic oligonucleotide
cgacgtctgttctacctccc

SEQ ID NO: 403 - DNA, 20 bp, Artificial Sequence
  Description of Artificial Sequence: Synthetic oligonucleotide
cgtttcctctggttcgtttc

SEQ ID NO: 404 - DNA, 20 bp, Artificial Sequence
  Description of Artificial Sequence: Synthetic oligonucleotide
gcccctcgttctgtactccc

SEQ ID NO: 405 - DNA, 20 bp, Artificial Sequence
  Description of Artificial Sequence: Synthetic oligonucleotide
gcgcactcgtttgcactccc

SEQ ID NO: 406 - DNA, 20 bp, Artificial Sequence
  Description of Artificial Sequence: Synthetic oligonucleotide
gcttttcgtttgccgctccc

SEQ ID NO: 407 - DNA, 21 bp, Artificial Sequence
  Description of Artificial Sequence: Synthetic oligonucleotide
gtcctgtcgtctgttcgtacc

SEQ ID NO: 408 - DNA, 21 bp, Artificial Sequence
  Description of Artificial Sequence: Synthetic oligonucleotide
gtcctgtcgtctgttcgtctc

SEQ ID NO: 409 - DNA, 20 bp, Artificial Sequence
  Description of Artificial Sequence: Synthetic oligonucleotide
tcatgtcgtctgttagtccc

SEQ ID NO: 410 - DNA, 20 bp, Artificial Sequence
  Description of Artificial Sequence: Synthetic oligonucleotide
tccagtcgatctgttgccgc

SEQ ID NO: 411 - DNA, 20 bp, Artificial Sequence
  Description of Artificial Sequence: Synthetic oligonucleotide
tcctggcttgccgttgtccc

SEQ ID NO: 412 - DNA, 19 bp, Artificial Sequence
  Description of Artificial Sequence: Synthetic oligonucleotide
tcctggcttgtcgtgtccc

SEQ ID NO: 413 - DNA, 20 bp, Artificial Sequence
  Description of Artificial Sequence: Synthetic oligonucleotide
tcctgtcgtctgctcgtttc

SEQ ID NO: 414 - DNA, 19 bp, Artificial Sequence
  Description of Artificial Sequence: Synthetic oligonucleotide
tccttcgtctgttcgtccc

SEQ ID NO: 415 - DNA, 20 bp, Artificial Sequence
  Description of Artificial Sequence: Synthetic oligonucleotide
ctgtctaccttctactgccc

SEQ ID NO: 416 - DNA, 20 bp, Artificial Sequence
  Description of Artificial Sequence: Synthetic oligonucleotide
ccattcgtctgttgcctccc

SEQ ID NO: 417 - DNA, 20 bp, Artificial Sequence
  Description of Artificial Sequence: Synthetic oligonucleotide
cgatctcgtctgaacctccc

SEQ ID NO: 418 - DNA, 20 bp, Artificial Sequence
  Description of Artificial Sequence: Synthetic oligonucleotide
gccactcgtctaatcgtccc

SEQ ID NO: 419 - DNA, 22 bp, Artificial Sequence
  Description of Artificial Sequence: Synthetic oligonucleotide
gccttctcgtctgttgtctccc

SEQ ID NO: 420 - DNA, 20 bp, Artificial Sequence
  Description of Artificial Sequence: Synthetic oligonucleotide
gcgcttcctctgaacctccc

SEQ ID NO: 421 - DNA, 20 bp, Artificial Sequence
  Description of Artificial Sequence: Synthetic oligonucleotide
gcgcttcctctgttcgtccc

SEQ ID NO: 422 - DNA, 20 bp, Artificial Sequence
  Description of Artificial Sequence: Synthetic oligonucleotide
gcttctcgtctgtccctccc

SEQ ID NO: 423 - DNA, 20 bp, Artificial Sequence
  Description of Artificial Sequence: Synthetic oligonucleotide
gcttttcgtactgcgctccc

SEQ ID NO: 424 - DNA, 20 bp, Artificial Sequence
  Description of Artificial Sequence: Synthetic oligonucleotide
tcctgtcgtatgttcgtcac

SEQ ID NO: 425 - DNA, 20 bp, Artificial Sequence
  Description of Artificial Sequence: Synthetic oligonucleotide
tcctgtcgtctgttctttcc

SEQ ID NO: 426 - DNA, 20 bp, Artificial Sequence
  Description of Artificial Sequence: Synthetic oligonucleotide
tgactcgtctgccgactccc

SEQ ID NO: 427 - DNA, 21 bp, Artificial Sequence
  Description of Artificial Sequence: Synthetic oligonucleotide
ttcctgtcgtctgttcgtccc

SEQ ID NO: 428 - DNA, 20 bp, Artificial Sequence
  Description of Artificial Sequence: Synthetic oligonucleotide
ttctggcttgtcgttgtccc

SEQ ID NO: 429 - DNA, 20 bp, Artificial Sequence
  Description of Artificial Sequence: Synthetic oligonucleotide
tctgggactttcctccgccc

SEQ ID NO: 430 - DNA, 20 bp, Artificial Sequence
  Description of Artificial Sequence: Synthetic oligonucleotide
ccctatcgtctgttcgtccc

SEQ ID NO: 431 - DNA, 19 bp, Artificial Sequence
  Description of Artificial Sequence: Synthetic oligonucleotide
ccctgtcgtctgttgtccc

SEQ ID NO: 432 - DNA, 20 bp, Artificial Sequence
  Description of Artificial Sequence: Synthetic oligonucleotide
ccctgttgtctgttcgtccc

SEQ ID NO: 433 - DNA, 19 bp, Artificial Sequence
  Description of Artificial Sequence: Synthetic oligonucleotide
cgagcctctgtttcttccc

SEQ ID NO: 434 - DNA, 20 bp, Artificial Sequence
  Description of Artificial Sequence: Synthetic oligonucleotide
cgatctccgtctgcactccc

SEQ ID NO: 435 - DNA, 20 bp, Artificial Sequence
  Description of Artificial Sequence: Synthetic oligonucleotide
gccttcgtctgtctcctccc

SEQ ID NO: 436 - DNA, 20 bp, Artificial Sequence
  Description of Artificial Sequence: Synthetic oligonucleotide
gcgtttcctctgctcgtccc

SEQ ID NO: 437 - DNA, 20 bp, Artificial Sequence
  Description of Artificial Sequence: Synthetic oligonucleotide
gctgtctcgtctgacctccc

SEQ ID NO: 438 - DNA, 20 bp, Artificial Sequence
  Description of Artificial Sequence: Synthetic oligonucleotide
ggcttttcgtctgccctccc

SEQ ID NO: 439 - DNA, 21 bp, Artificial Sequence
  Description of Artificial Sequence: Synthetic oligonucleotide
gtcctatcgtctgttcgtccc

SEQ ID NO: 440 - DNA, 21 bp, Artificial Sequence
  Description of Artificial Sequence: Synthetic oligonucleotide
gtcctgtcatctgttcgtccc

SEQ ID NO: 441 - DNA, 20 bp, Artificial Sequence
  Description of Artificial Sequence: Synthetic oligonucleotide
gtgtttcgtcgttgcgtccc

SEQ ID NO: 442 - DNA, 20 bp, Artificial Sequence
  Description of Artificial Sequence: Synthetic oligonucleotide
tcatgtagtctgttcgtccc

SEQ ID NO: 443 - DNA, 20 bp, Artificial Sequence
  Description of Artificial Sequence: Synthetic oligonucleotide
tcctgtcgtctgctcctccc

SEQ ID NO: 444 - DNA, 20 bp, Artificial Sequence
  Description of Artificial Sequence: Synthetic oligonucleotide
tcttgtcgtccgttcgtccc

SEQ ID NO: 445 - DNA, 20 bp, Artificial Sequence
  Description of Artificial Sequence: Synthetic oligonucleotide
tgcggtctctggttcctccc

SEQ ID NO: 446 - DNA, 17 bp, Artificial Sequence
  Description of Artificial Sequence: Synthetic oligonucleotide
tgtcgtctgttcgtccc

SEQ ID NO: 447 - DNA, 20 bp, Artificial Sequence
  Description of Artificial Sequence: Synthetic oligonucleotide
tcctgtcgtctgttagtaca

SEQ ID NO: 448 - DNA, 20 bp, Artificial Sequence
  Description of Artificial Sequence: Synthetic oligonucleotide
tctctgggtttttgctgccc

SEQ ID NO: 449 - DNA, 20 bp, Artificial Sequence
  Description of Artificial Sequence: Synthetic oligonucleotide
tttggggtttttcccgtccc

SEQ ID NO: 450 - DNA, 20 bp, Artificial Sequence
  Description of Artificial Sequence: Synthetic oligonucleotide
gatcatgttttcctttcgtc

SEQ ID NO: 451 - DNA, 20 bp, Artificial Sequence
  Description of Artificial Sequence: Synthetic oligonucleotide
ccagttgttctgagcctccc

SEQ ID NO: 452 - DNA, 20 bp, Artificial Sequence
  Description of Artificial Sequence: Synthetic oligonucleotide
ccatgtcgtctgttcgtccc

SEQ ID NO: 453 - DNA, 19 bp, Artificial Sequence
  Description of Artificial Sequence: Synthetic oligonucleotide
ccctgtcgtctgtcgtccc

SEQ ID NO: 454 - DNA, 20 bp, Artificial Sequence
  Description of Artificial Sequence: Synthetic oligonucleotide
cgacttccgtctgcgctccc

SEQ ID NO: 455 - DNA, 20 bp, Artificial Sequence
  Description of Artificial Sequence: Synthetic oligonucleotide
cttgtcttctggttcgtccc

SEQ ID NO: 456 - DNA, 20 bp, Artificial Sequence
  Description of Artificial Sequence: Synthetic oligonucleotide
gccttcgtctgcttactccc

SEQ ID NO: 457 - DNA, 20 bp, Artificial Sequence
  Description of Artificial Sequence: Synthetic oligonucleotide
tcctagcttgtcgttgtccc

SEQ ID NO: 458 - DNA, 20 bp, Artificial Sequence
  Description of Artificial Sequence: Synthetic oligonucleotide
tcctggtttgtcgttgtccc

SEQ ID NO: 459 - DNA, 21 bp, Artificial Sequence
  Description of Artificial Sequence: Synthetic oligonucleotide
tcctgtcgtcttgttcgtccc

SEQ ID NO: 460 - DNA, 20 bp, Artificial Sequence
  Description of Artificial Sequence: Synthetic oligonucleotide
tcctgtcgttcgttcgtccc

SEQ ID NO: 461 - DNA, 20 bp, Artificial Sequence
  Description of Artificial Sequence: Synthetic oligonucleotide
tcttgccgtctgttcgtccc

SEQ ID NO: 462 - DNA, 20 bp, Artificial Sequence
  Description of Artificial Sequence: Synthetic oligonucleotide
tcttgtcgtctgttcgcccc

SEQ ID NO: 463 - DNA, 20 bp, Artificial Sequence
  Description of Artificial Sequence: Synthetic oligonucleotide
tgccttcgtctgctcctccc

SEQ ID NO: 464 - DNA, 20 bp, Artificial Sequence
  Description of Artificial Sequence: Synthetic oligonucleotide
gtcctttcgtctgtgctccc

SEQ ID NO: 465 - DNA, 20 bp, Artificial Sequence
  Description of Artificial Sequence: Synthetic oligonucleotide
ttcggggttttcccgtgccc

SEQ ID NO: 466 - DNA, 21 bp, Artificial Sequence
  Description of Artificial Sequence: Synthetic oligonucleotide
tttggggttttccccgtgccc

SEQ ID NO: 467 - DNA, 20 bp, Artificial Sequence
  Description of Artificial Sequence: Synthetic oligonucleotide
ccctggcttgtcgttgtccc

SEQ ID NO: 468 - DNA, 20 bp, Artificial Sequence
  Description of Artificial Sequence: Synthetic oligonucleotide
ccgtctcgtctgtagctccc

SEQ ID NO: 469 - DNA, 19 bp, Artificial Sequence
  Description of Artificial Sequence: Synthetic oligonucleotide
cctgatcgtctgtgctccc

SEQ ID NO: 470 - DNA, 20 bp, Artificial Sequence
  Description of Artificial Sequence: Synthetic oligonucleotide
cctgtcgtttgtttccgccc

SEQ ID NO: 471 - DNA, 20 bp, Artificial Sequence
  Description of Artificial Sequence: Synthetic oligonucleotide
cgacttccgtctgtctcccc

SEQ ID NO: 472 - DNA, 20 bp, Artificial Sequence
  Description of Artificial Sequence: Synthetic oligonucleotide
cgatcctcgtctgttgtccc

SEQ ID NO: 473 - DNA, 20 bp, Artificial Sequence
  Description of Artificial Sequence: Synthetic oligonucleotide
cttgtcgtcttgctcgtccc

SEQ ID NO: 474 - DNA, 20 bp, Artificial Sequence
  Description of Artificial Sequence: Synthetic oligonucleotide
gcatctcgtctgtacctccc

SEQ ID NO: 475 - DNA, 20 bp, Artificial Sequence
  Description of Artificial Sequence: Synthetic oligonucleotide
gcctcttgtctgttgctccc

SEQ ID NO: 476 - DNA, 20 bp, Artificial Sequence
  Description of Artificial Sequence: Synthetic oligonucleotide
gcctgtcgtgttttcgtccc

SEQ ID NO: 477 - DNA, 20 bp, Artificial Sequence
  Description of Artificial Sequence: Synthetic oligonucleotide
gcctttcgtctctacgtccc

SEQ ID NO: 478 - DNA, 20 bp, Artificial Sequence
  Description of Artificial Sequence: Synthetic oligonucleotide
gcctttcgtttgctcttccc

SEQ ID NO: 479 - DNA, 20 bp, Artificial Sequence
  Description of Artificial Sequence: Synthetic oligonucleotide
gcgtttcctctgcccttccc

SEQ ID NO: 480 - DNA, 21 bp, Artificial Sequence
  Description of Artificial Sequence: Synthetic oligonucleotide
gtcctgtcgtctgttcgtcca

SEQ ID NO: 481 - DNA, 21 bp, Artificial Sequence
  Description of Artificial Sequence: Synthetic oligonucleotide
gttctgtcgtctgttcgtccc

SEQ ID NO: 482 - DNA, 20 bp, Artificial Sequence
  Description of Artificial Sequence: Synthetic oligonucleotide
tactgtagtctgttcgtccc

SEQ ID NO: 483 - DNA, 20 bp, Artificial Sequence
  Description of Artificial Sequence: Synthetic oligonucleotide
tactgtcgtctgttcgtcac

SEQ ID NO: 484 - DNA, 20 bp, Artificial Sequence
  Description of Artificial Sequence: Synthetic oligonucleotide
tactgtcgtctgttcgtcca

SEQ ID NO: 485 - DNA, 20 bp, Artificial Sequence
  Description of Artificial Sequence: Synthetic oligonucleotide
tcttgtcgtctattcgtccc

SEQ ID NO: 486 - DNA, 20 bp, Artificial Sequence
  Description of Artificial Sequence: Synthetic oligonucleotide
tcttgtcgtctgttcatccc

SEQ ID NO: 487 - DNA, 20 bp, Artificial Sequence
  Description of Artificial Sequence: Synthetic oligonucleotide
tcttgtcgtctgttcctccc

SEQ ID NO: 488 - DNA, 21 bp, Artificial Sequence
  Description of Artificial Sequence: Synthetic oligonucleotide
ttttggggttttcccgtgccc

SEQ ID NO: 489 - DNA, 20 bp, Artificial Sequence
  Description of Artificial Sequence: Synthetic oligonucleotide
ccctgtagtctgttcgtccc

SEQ ID NO: 490 - DNA, 20 bp, Artificial Sequence
  Description of Artificial Sequence: Synthetic oligonucleotide
ccctgtcgtctgttagtccc

SEQ ID NO: 491 - DNA, 20 bp, Artificial Sequence
  Description of Artificial Sequence: Synthetic oligonucleotide
ccctgtcgtctgttcgtacc

SEQ ID NO: 492 - DNA, 20 bp, Artificial Sequence
  Description of Artificial Sequence: Synthetic oligonucleotide
ccctgtcgtctgttcgtcct

SEQ ID NO: 493 - DNA, 19 bp, Artificial Sequence
  Description of Artificial Sequence: Synthetic oligonucleotide
ccctgtcgtctgttctccc

SEQ ID NO: 494 - DNA, 20 bp, Artificial Sequence
  Description of Artificial Sequence: Synthetic oligonucleotide
cgactcttctgctcctgccc

SEQ ID NO: 495 - DNA, 20 bp, Artificial Sequence
  Description of Artificial Sequence: Synthetic oligonucleotide
cgtctcctctggttcgtccc

SEQ ID NO: 496 - DNA, 20 bp, Artificial Sequence
  Description of Artificial Sequence: Synthetic oligonucleotide
cgtcttcgtctgtgggccgc

SEQ ID NO: 497 - DNA, 20 bp, Artificial Sequence
  Description of Artificial Sequence: Synthetic oligonucleotide
cgtttcgttctgaccgtccc

SEQ ID NO: 498 - DNA, 20 bp, Artificial Sequence
  Description of Artificial Sequence: Synthetic oligonucleotide
gcattcgatctgccactccc

SEQ ID NO: 499 - DNA, 20 bp, Artificial Sequence
  Description of Artificial Sequence: Synthetic oligonucleotide
gcccttcgttctgacctccc

SEQ ID NO: 500 - DNA, 20 bp, Artificial Sequence
  Description of Artificial Sequence: Synthetic oligonucleotide
gcctactcgtctgacctccc

SEQ ID NO: 501 - DNA, 20 bp, Artificial Sequence
  Description of Artificial Sequence: Synthetic oligonucleotide
gcttttcgtctgcgcctccc

SEQ ID NO: 502 - DNA, 20 bp, Artificial Sequence
  Description of Artificial Sequence: Synthetic oligonucleotide
tactgtcgtatgttcgtccc

SEQ ID NO: 503 - DNA, 20 bp, Artificial Sequence
  Description of Artificial Sequence: Synthetic oligonucleotide
tcctgacgtctgttcgtcca

SEQ ID NO: 504 - DNA, 20 bp, Artificial Sequence
  Description of Artificial Sequence: Synthetic oligonucleotide
tcctggcttgtcgttatccc

SEQ ID NO: 505 - DNA, 19 bp, Artificial Sequence
  Description of Artificial Sequence: Synthetic oligonucleotide
tcctggcttgtcttgtccc

SEQ ID NO: 506 - DNA, 20 bp, Artificial Sequence
  Description of Artificial Sequence: Synthetic oligonucleotide
tcctgtcgtctgttcgctcc

SEQ ID NO: 507 - DNA, 20 bp, Artificial Sequence
  Description of Artificial Sequence: Synthetic oligonucleotide
tcctgtcgtctgttcgtcgg

SEQ ID NO: 508 - DNA, 20 bp, Artificial Sequence
  Description of Artificial Sequence: Synthetic oligonucleotide
tcctgtcgtctgttcgttac

SEQ ID NO: 509 - DNA, 20 bp, Artificial Sequence
  Description of Artificial Sequence: Synthetic oligonucleotide
tcggtcgtctacttcgtccc

SEQ ID NO: 510 - DNA, 20 bp, Artificial Sequence
  Description of Artificial Sequence: Synthetic oligonucleotide
tctctggtgtttcgggccgc

SEQ ID NO: 511 - DNA, 20 bp, Artificial Sequence
  Description of Artificial Sequence: Synthetic oligonucleotide
tcttgtcgtctgtccgtccc

SEQ ID NO: 512 - DNA, 19 bp, Artificial Sequence
  Description of Artificial Sequence: Synthetic oligonucleotide
tcttgtcgtctgttgtccc

SEQ ID NO: 513 - DNA, 20 bp, Artificial Sequence
  Description of Artificial Sequence: Synthetic oligonucleotide
tgaatcgttctgcgcctccc

SEQ ID NO: 514 - DNA, 20 bp, Artificial Sequence
  Description of Artificial Sequence: Synthetic oligonucleotide
acggctcgtctgttgctccc

SEQ ID NO: 515 - DNA, 20 bp, Artificial Sequence
  Description of Artificial Sequence: Synthetic oligonucleotide
cagtcgttctgtctcctccc

SEQ ID NO: 516 - DNA, 20 bp, Artificial Sequence
  Description of Artificial Sequence: Synthetic oligonucleotide
ccctgtcgtttgttcgtccc

SEQ ID NO: 517 - DNA, 20 bp, Artificial Sequence
  Description of Artificial Sequence: Synthetic oligonucleotide
ccgtgtcgtctgtactgccc

SEQ ID NO: 518 - DNA, 20 bp, Artificial Sequence
  Description of Artificial Sequence: Synthetic oligonucleotide
cgactcgatctgtaactccc

SEQ ID NO: 519 - DNA, 19 bp, Artificial Sequence
  Description of Artificial Sequence: Synthetic oligonucleotide
cttgtcgtctgttcgtccc

SEQ ID NO: 520 - DNA, 20 bp, Artificial Sequence
  Description of Artificial Sequence: Synthetic oligonucleotide
gcctctcgtctgttcgtccc

SEQ ID NO: 521 - DNA, 20 bp, Artificial Sequence
  Description of Artificial Sequence: Synthetic oligonucleotide
gccttcgtttgtaccctccc

SEQ ID NO: 522 - DNA, 20 bp, Artificial Sequence
  Description of Artificial Sequence: Synthetic oligonucleotide
gcgattcctctgcacctccc

SEQ ID NO: 523 - DNA, 21 bp, Artificial Sequence
  Description of Artificial Sequence: Synthetic oligonucleotide
gtcctgtcgtctgatcgtccc

SEQ ID NO: 524 - DNA, 20 bp, Artificial Sequence
  Description of Artificial Sequence: Synthetic oligonucleotide
gtttgtcgtctgttcgtccc

SEQ ID NO: 525 - DNA, 20 bp, Artificial Sequence
  Description of Artificial Sequence: Synthetic oligonucleotide
tcatgtcgtatgttcgtccc

SEQ ID NO: 526 - DNA, 20 bp, Artificial Sequence
  Description of Artificial Sequence: Synthetic oligonucleotide
tcatgtcgtctgttcgtaca

SEQ ID NO: 527 - DNA, 19 bp, Artificial Sequence
  Description of Artificial Sequence: Synthetic oligonucleotide
tcctgtcgtctgtcctccc

SEQ ID NO: 528 - DNA, 20 bp, Artificial Sequence
  Description of Artificial Sequence: Synthetic oligonucleotide
tcctgtcgtctgttcgttca

SEQ ID NO: 529 - DNA, 18 bp, Artificial Sequence
  Description of Artificial Sequence: Synthetic oligonucleotide
tcctgtcgtctgttctcc

SEQ ID NO: 530 - DNA, 20 bp, Artificial Sequence
  Description of Artificial Sequence: Synthetic oligonucleotide
tcctgtcgtttgtttgtccc

SEQ ID NO: 531 - DNA, 20 bp, Artificial Sequence
  Description of Artificial Sequence: Synthetic oligonucleotide
tcggttctggtttctgccgc

SEQ ID NO: 532 - DNA, 20 bp, Artificial Sequence
  Description of Artificial Sequence: Synthetic oligonucleotide
tcttgtcgtctgttcgtacc

SEQ ID NO: 533 - DNA, 20 bp, Artificial Sequence
  Description of Artificial Sequence: Synthetic oligonucleotide
tcttgttgtctgttcgtccc

SEQ ID NO: 534 - DNA, 20 bp, Artificial Sequence
  Description of Artificial Sequence: Synthetic oligonucleotide
tggtcgtctgatttcgtccc

SEQ ID NO: 535 - DNA, 20 bp, Artificial Sequence
  Description of Artificial Sequence: Synthetic oligonucleotide
tttggggatttcccgtgccc

SEQ ID NO: 536 - DNA, 20 bp, Artificial Sequence
  Description of Artificial Sequence: Synthetic oligonucleotide
tttggggttttcccgtgtcc

SEQ ID NO: 537 - DNA, 20 bp, Artificial Sequence
  Description of Artificial Sequence: Synthetic oligonucleotide
tttggggttatcccgtgccc

SEQ ID NO: 538 - DNA, 20 bp, Artificial Sequence
  Description of Artificial Sequence: Synthetic oligonucleotide
tttggggttttcccgtgcct

SEQ ID NO: 539 - DNA, 20 bp, Artificial Sequence
  Description of Artificial Sequence: Synthetic oligonucleotide
tttggggttttcccgtaccc

SEQ ID NO: 540 - DNA, 20 bp, Artificial Sequence
  Description of Artificial Sequence: Synthetic oligonucleotide
acgttctcgtctgtggccgc

SEQ ID NO: 541 - DNA, 20 bp, Artificial Sequence
  Description of Artificial Sequence: Synthetic oligonucleotide
cccagtcgtctgttcgtccc

SEQ ID NO: 542 - DNA, 20 bp, Artificial Sequence
  Description of Artificial Sequence: Synthetic oligonucleotide
ccctgtcgtctgttcgtcca

SEQ ID NO: 543 - DNA, 20 bp, Artificial Sequence
  Description of Artificial Sequence: Synthetic oligonucleotide
ccgagttgtttgcgcctccc

SEQ ID NO: 544 - DNA, 20 bp, Artificial Sequence
  Description of Artificial Sequence: Synthetic oligonucleotide
cgttgtcggtctgtgctccc

SEQ ID NO: 545 - DNA, 20 bp, Artificial Sequence
  Description of Artificial Sequence: Synthetic oligonucleotide
gcctcgtctgaactcctccc

SEQ ID NO: 546 - DNA, 20 bp, Artificial Sequence
  Description of Artificial Sequence: Synthetic oligonucleotide
gcgtctcctctgttcgtccc

SEQ ID NO: 547 - DNA, 20 bp, Artificial Sequence
  Description of Artificial Sequence: Synthetic oligonucleotide
gctactcgttctgccctccc

SEQ ID NO: 548 - DNA, 20 bp, Artificial Sequence
  Description of Artificial Sequence: Synthetic oligonucleotide
gctcgttcgtctttcgtccc

SEQ ID NO: 549 - DNA, 20 bp, Artificial Sequence
  Description of Artificial Sequence: Synthetic oligonucleotide
gcttttcgtttgttcgtccc

SEQ ID NO: 550 - DNA, 21 bp, Artificial Sequence
  Description of Artificial Sequence: Synthetic oligonucleotide
gtcctgtcgtctgttagtccc

SEQ ID NO: 551 - DNA, 20 bp, Artificial Sequence
  Description of Artificial Sequence: Synthetic oligonucleotide
gtgttcgtctgtttcgtccc

SEQ ID NO: 552 - DNA, 21 bp, Artificial Sequence
  Description of Artificial Sequence: Synthetic oligonucleotide
gttcgtcgtttgtttcgtccc

SEQ ID NO: 553 - DNA, 20 bp, Artificial Sequence
  Description of Artificial Sequence: Synthetic oligonucleotide
tcctgacttgtcgttgtccc

SEQ ID NO: 554 - DNA, 20 bp, Artificial Sequence
  Description of Artificial Sequence: Synthetic oligonucleotide
tcctgccgtctgttcgttcc

SEQ ID NO: 555 - DNA, 20 bp, Artificial Sequence
  Description of Artificial Sequence: Synthetic oligonucleotide
tcctgtcgtctgcttgtccc

SEQ ID NO: 556 - DNA, 20 bp, Artificial Sequence
  Description of Artificial Sequence: Synthetic oligonucleotide
tcctgtcgtctgtccttccc

SEQ ID NO: 557 - DNA, 19 bp, Artificial Sequence
  Description of Artificial Sequence: Synthetic oligonucleotide
tcttgtcgtctgttctccc

SEQ ID NO: 558 - DNA, 20 bp, Artificial Sequence
  Description of Artificial Sequence: Synthetic oligonucleotide
tgactcgtctgtctcgtccc

SEQ ID NO: 559 - DNA, 20 bp, Artificial Sequence
  Description of Artificial Sequence: Synthetic oligonucleotide
tttggggttttcccgttccc

SEQ ID NO: 560 - DNA, 19 bp, Artificial Sequence
  Description of Artificial Sequence: Synthetic oligonucleotide
tttggggttttcccgtccc

SEQ ID NO: 561 - DNA, 20 bp, Artificial Sequence
  Description of Artificial Sequence: Synthetic oligonucleotide
tttggggttttcctgtgccc

SEQ ID NO: 562 - DNA, 21 bp, Artificial Sequence
  Description of Artificial Sequence: Synthetic oligonucleotide
tttggggcttttcccgtgccc

SEQ ID NO: 563 - DNA, 20 bp, Artificial Sequence
  Description of Artificial Sequence: Synthetic oligonucleotide
acctgtcgtctgttcgtcca

SEQ ID NO: 564 - DNA, 20 bp, Artificial Sequence
  Description of Artificial Sequence: Synthetic oligonucleotide
ccctgtcctctgttcgtccc

SEQ ID NO: 565 - DNA, 20 bp, Artificial Sequence
  Description of Artificial Sequence: Synthetic oligonucleotide
ccctgtcgtctattcgtccc

SEQ ID NO: 566 - DNA, 17 bp, Artificial Sequence
  Description of Artificial Sequence: Synthetic oligonucleotide
ccctgtcgtctgttccc

SEQ ID NO: 567 - DNA, 20 bp, Artificial Sequence
  Description of Artificial Sequence: Synthetic oligonucleotide
ccgattcgtttgccactccc

SEQ ID NO: 568 - DNA, 20 bp, Artificial Sequence
  Description of Artificial Sequence: Synthetic oligonucleotide
cctgatcgtctgcagctccc

SEQ ID NO: 569 - DNA, 21 bp, Artificial Sequence
  Description of Artificial Sequence: Synthetic oligonucleotide
cctgtcgtcttttttcgtccc

SEQ ID NO: 570 - DNA, 20 bp, Artificial Sequence
  Description of Artificial Sequence: Synthetic oligonucleotide
cgactctctgatgtccaccc

SEQ ID NO: 571 - DNA, 20 bp, Artificial Sequence
  Description of Artificial Sequence: Synthetic oligonucleotide
cgcttcctctggttcgtccc

SEQ ID NO: 572 - DNA, 20 bp, Artificial Sequence
  Description of Artificial Sequence: Synthetic oligonucleotide
cgctttcgttctgcgctccc

SEQ ID NO: 573 - DNA, 20 bp, Artificial Sequence
  Description of Artificial Sequence: Synthetic oligonucleotide
cgcttttcgtctgctctccc

SEQ ID NO: 574 - DNA, 20 bp, Artificial Sequence
  Description of Artificial Sequence: Synthetic oligonucleotide
cgtatctcgtctgctctccc

SEQ ID NO: 575 - DNA, 20 bp, Artificial Sequence
  Description of Artificial Sequence: Synthetic oligonucleotide
gcatgctcgtctcacgtccc

SEQ ID NO: 576 - DNA, 20 bp, Artificial Sequence
  Description of Artificial Sequence: Synthetic oligonucleotide
gccactcgtctaaacctccc

SEQ ID NO: 577 - DNA, 20 bp, Artificial Sequence
  Description of Artificial Sequence: Synthetic oligonucleotide
gcccttcgtttgacactccc

SEQ ID NO: 578 - DNA, 21 bp, Artificial Sequence
  Description of Artificial Sequence: Synthetic oligonucleotide
gcgtttcctctggttcgtccc

SEQ ID NO: 579 - DNA, 20 bp, Artificial Sequence
  Description of Artificial Sequence: Synthetic oligonucleotide
gcgtttcctctgtccgtccc

SEQ ID NO: 580 - DNA, 21 bp, Artificial Sequence
  Description of Artificial Sequence: Synthetic oligonucleotide
gtcctctcgtctgttcgtccc

SEQ ID NO: 581 - DNA, 21 bp, Artificial Sequence
  Description of Artificial Sequence: Synthetic oligonucleotide
gtcctttcgtctgttcgtccc

SEQ ID NO: 582 - DNA, 20 bp, Artificial Sequence
  Description of Artificial Sequence: Synthetic oligonucleotide
gtcttcgtctgttgcctccc

SEQ ID NO: 583 - DNA, 20 bp, Artificial Sequence
  Description of Artificial Sequence: Synthetic oligonucleotide
gttcatttttgccgcgtggc

SEQ ID NO: 584 - DNA, 20 bp, Artificial Sequence
  Description of Artificial Sequence: Synthetic oligonucleotide
gttcgtcgtcttatcgtccc

SEQ ID NO: 585 - DNA, 20 bp, Artificial Sequence
  Description of Artificial Sequence: Synthetic oligonucleotide
taatgtcgtctgttcgtccc

SEQ ID NO: 586 - DNA, 20 bp, Artificial Sequence
  Description of Artificial Sequence: Synthetic oligonucleotide
tactgtcgtctgttagtccc

SEQ ID NO: 587 - DNA, 20 bp, Artificial Sequence
  Description of Artificial Sequence: Synthetic oligonucleotide
tcatgtcgtctgttagtacc

SEQ ID NO: 588 - DNA, 20 bp, Artificial Sequence
  Description of Artificial Sequence: Synthetic oligonucleotide
tcctgacgtctgttcgtacc

SEQ ID NO: 589 - DNA, 20 bp, Artificial Sequence
  Description of Artificial Sequence: Synthetic oligonucleotide
tcctgtagtctgttagtcac

SEQ ID NO: 590 - DNA, 20 bp, Artificial Sequence
  Description of Artificial Sequence: Synthetic oligonucleotide
tcctgtagtctgttcgtaca

SEQ ID NO: 591 - DNA, 20 bp, Artificial Sequence
  Description of Artificial Sequence: Synthetic oligonucleotide
tcctgtcgcctgttcgcccc

SEQ ID NO: 592 - DNA, 20 bp, Artificial Sequence
  Description of Artificial Sequence: Synthetic oligonucleotide
tcctgtcgtccgttcgcccc

SEQ ID NO: 593 - DNA, 18 bp, Artificial Sequence
  Description of Artificial Sequence: Synthetic oligonucleotide
tcctgtcgtcgtcgtccc

SEQ ID NO: 594 - DNA, 20 bp, Artificial Sequence
  Description of Artificial Sequence: Synthetic oligonucleotide
tcctgtcgtctgatcgtacc

SEQ ID NO: 595 - DNA, 20 bp, Artificial Sequence
  Description of Artificial Sequence: Synthetic oligonucleotide
tcctgtcgtctgcccgtccc

SEQ ID NO: 596 - DNA, 17 bp, Artificial Sequence
  Description of Artificial Sequence: Synthetic oligonucleotide
tcctgtcgtctggtccc

SEQ ID NO: 597 - DNA, 20 bp, Artificial Sequence
  Description of Artificial Sequence: Synthetic oligonucleotide
tcctgtcgtctgttccttcc

SEQ ID NO: 598 - DNA, 17 bp, Artificial Sequence
  Description of Artificial Sequence: Synthetic oligonucleotide
tcctgtcgtctgttcgt

SEQ ID NO: 599 - DNA, 20 bp, Artificial Sequence
  Description of Artificial Sequence: Synthetic oligonucleotide
tccttgcttgtcgttgtccc

SEQ ID NO: 600 - DNA, 20 bp, Artificial Sequence
  Description of Artificial Sequence: Synthetic oligonucleotide
tcttgtcgcctgttcgtccc

SEQ ID NO: 601 - DNA, 20 bp, Artificial Sequence
  Description of Artificial Sequence: Synthetic oligonucleotide
tgagcgtctgctttcgtccc

SEQ ID NO: 602 - DNA, 20 bp, Artificial Sequence
  Description of Artificial Sequence: Synthetic oligonucleotide
tgatgttcgtctgccgtccc

SEQ ID NO: 603 - DNA, 20 bp, Artificial Sequence
  Description of Artificial Sequence: Synthetic oligonucleotide
tcctgtcgtcttttcgttcc

SEQ ID NO: 604 - DNA, 20 bp, Artificial Sequence
  Description of Artificial Sequence: Synthetic oligonucleotide
tttggggttttcccctgccc

SEQ ID NO: 605 - DNA, 20 bp, Artificial Sequence
  Description of Artificial Sequence: Synthetic oligonucleotide
agcctttcgtctgcactccc

SEQ ID NO: 606 - DNA, 20 bp, Artificial Sequence
  Description of Artificial Sequence: Synthetic oligonucleotide
ccattcgtctgatacctccc

SEQ ID NO: 607 - DNA, 20 bp, Artificial Sequence
  Description of Artificial Sequence: Synthetic oligonucleotide
cccgtcgtcttttgcctccc

SEQ ID NO: 608 - DNA, 20 bp, Artificial Sequence
  Description of Artificial Sequence: Synthetic oligonucleotide
ccctgtcgtctcttcgtccc

SEQ ID NO: 609 - DNA, 20 bp, Artificial Sequence
  Description of Artificial Sequence: Synthetic oligonucleotide
cctgtcgtcttacacgtccc

SEQ ID NO: 610 - DNA, 20 bp, Artificial Sequence
  Description of Artificial Sequence: Synthetic oligonucleotide
cgacgtctgaattacctccc

SEQ ID NO: 611 - DNA, 20 bp, Artificial Sequence
  Description of Artificial Sequence: Synthetic oligonucleotide
cgactcctctgtatcctccg

SEQ ID NO: 612 - DNA, 20 bp, Artificial Sequence
  Description of Artificial Sequence: Synthetic oligonucleotide
cgagcctctgaatctctccc

SEQ ID NO: 613 - DNA, 20 bp, Artificial Sequence
  Description of Artificial Sequence: Synthetic oligonucleotide
cgtagtcctctgaacctccc

SEQ ID NO: 614 - DNA, 20 bp, Artificial Sequence
  Description of Artificial Sequence: Synthetic oligonucleotide
ctagtcgtttgcctcctccc

SEQ ID NO: 615 - DNA, 20 bp, Artificial Sequence
  Description of Artificial Sequence: Synthetic oligonucleotide
ctttgtcgtctgttcgtccc

SEQ ID NO: 616 - DNA, 20 bp, Artificial Sequence
  Description of Artificial Sequence: Synthetic oligonucleotide
gagtctcgtctgtccctccc

SEQ ID NO: 617 - DNA, 20 bp, Artificial Sequence
  Description of Artificial Sequence: Synthetic oligonucleotide
gccactcttctgctgctccc

SEQ ID NO: 618 - DNA, 20 bp, Artificial Sequence
  Description of Artificial Sequence: Synthetic oligonucleotide
gcctatcgtctgatcctccc

SEQ ID NO: 619 - DNA, 20 bp, Artificial Sequence
  Description of Artificial Sequence: Synthetic oligonucleotide
gcctcttgtctgaccttccc

SEQ ID NO: 620 - DNA, 20 bp, Artificial Sequence
  Description of Artificial Sequence: Synthetic oligonucleotide
gccttcgtctcttgcctccc

SEQ ID NO: 621 - DNA, 20 bp, Artificial Sequence
  Description of Artificial Sequence: Synthetic oligonucleotide
gcgttttctctgttcgtccc

SEQ ID NO: 622 - DNA, 21 bp, Artificial Sequence
  Description of Artificial Sequence: Synthetic oligonucleotide
gtcctgtcgtctgtctgtccc

SEQ ID NO: 623 - DNA, 20 bp, Artificial Sequence
  Description of Artificial Sequence: Synthetic oligonucleotide
gtcgtctttcgtctcgtccc

SEQ ID NO: 624 - DNA, 20 bp, Artificial Sequence
  Description of Artificial Sequence: Synthetic oligonucleotide
gtctttcgtctgcaactccc

SEQ ID NO: 625 - DNA, 20 bp, Artificial Sequence
  Description of Artificial Sequence: Synthetic oligonucleotide
tccagtcgtttgtttgccgc

SEQ ID NO: 626 - DNA, 20 bp, Artificial Sequence
  Description of Artificial Sequence: Synthetic oligonucleotide
tcccgtcgtctgctcgtccc

SEQ ID NO: 627 - DNA, 20 bp, Artificial Sequence
  Description of Artificial Sequence: Synthetic oligonucleotide
tcccgtcgtctgtccgtccc

SEQ ID NO: 628 - DNA, 20 bp, Artificial Sequence
  Description of Artificial Sequence: Synthetic oligonucleotide
tcctatcgtctattcgtccc

SEQ ID NO: 629 - DNA, 20 bp, Artificial Sequence
  Description of Artificial Sequence: Synthetic oligonucleotide
tcctggcttgtcgttctccc

SEQ ID NO: 630 - DNA, 20 bp, Artificial Sequence
  Description of Artificial Sequence: Synthetic oligonucleotide
tcctggcttgtcgttgtcca

SEQ ID NO: 631 - DNA, 20 bp, Artificial Sequence
  Description of Artificial Sequence: Synthetic oligonucleotide
tcctgtagtctgttcgttcc

SEQ ID NO: 632 - DNA, 20 bp, Artificial Sequence
  Description of Artificial Sequence: Synthetic oligonucleotide
tcctgtcgcctgctcgtccc

SEQ ID NO: 633 - DNA, 20 bp, Artificial Sequence
  Description of Artificial Sequence: Synthetic oligonucleotide
tcctgtcgtctctccgtccc

SEQ ID NO: 634 - DNA, 20 bp, Artificial Sequence
  Description of Artificial Sequence: Synthetic oligonucleotide
tcctgtcgtctgttcccccc

SEQ ID NO: 635 - DNA, 20 bp, Artificial Sequence
  Description of Artificial Sequence: Synthetic oligonucleotide
tcctgtcgtctgtttgtacc

SEQ ID NO: 636 - DNA, 20 bp, Artificial Sequence
  Description of Artificial Sequence: Synthetic oligonucleotide
tcctgtcgtctgtttttccc

SEQ ID NO: 637 - DNA, 20 bp, Artificial Sequence
  Description of Artificial Sequence: Synthetic oligonucleotide
tcctgtcgtttgttcgttcc

SEQ ID NO: 638 - DNA, 20 bp, Artificial Sequence
  Description of Artificial Sequence: Synthetic oligonucleotide
tcgactcgtctcatgctccc

SEQ ID NO: 639 - DNA, 20 bp, Artificial Sequence
  Description of Artificial Sequence: Synthetic oligonucleotide
tcttgtcatctgttcgtccc

SEQ ID NO: 640 - DNA, 19 bp, Artificial Sequence
  Description of Artificial Sequence: Synthetic oligonucleotide
tcttgtcgtctcgcgtccc

SEQ ID NO: 641 - DNA, 20 bp, Artificial Sequence
  Description of Artificial Sequence: Synthetic oligonucleotide
tcttgtcgtctgttagtccc

SEQ ID NO: 642 - DNA, 20 bp, Artificial Sequence
  Description of Artificial Sequence: Synthetic oligonucleotide
tcttgtcgtctgttcgtcca

SEQ ID NO: 643 - DNA, 21 bp, Artificial Sequence
  Description of Artificial Sequence: Synthetic oligonucleotide
tgactcgtctgttttcgtccc

SEQ ID NO: 644 - DNA, 20 bp, Artificial Sequence
  Description of Artificial Sequence: Synthetic oligonucleotide
tgtctgtcgtctgcgctccc

SEQ ID NO: 645 - DNA, 21 bp, Artificial Sequence
  Description of Artificial Sequence: Synthetic oligonucleotide
tttggggtctttcccgtgccc

SEQ ID NO: 646 - DNA, 20 bp, Artificial Sequence
  Description of Artificial Sequence: Synthetic oligonucleotide
tttggggttttaccgtgccc

SEQ ID NO: 647 - DNA, 19 bp, Artificial Sequence
  Description of Artificial Sequence: Synthetic oligonucleotide
tttggggttttccgtgccc

SEQ ID NO: 648 - DNA, 20 bp, Artificial Sequence
  Description of Artificial Sequence: Synthetic oligonucleotide
ttggggtttttcccgtgccc

SEQ ID NO: 649 - DNA, 20 bp, Artificial Sequence
  Description of Artificial Sequence: Synthetic oligonucleotide
tttggggttttcccgtcccc

SEQ ID NO: 650 - DNA, 21 bp, Artificial Sequence
  Description of Artificial Sequence: Synthetic oligonucleotide
tttggggtttttcccgtaccc

SEQ ID NO: 651 - DNA, 20 bp, Artificial Sequence
  Description of Artificial Sequence: Synthetic oligonucleotide
tttggggtattcccgtgccc

SEQ ID NO: 652 - DNA, 20 bp, Artificial Sequence
  Description of Artificial Sequence: Synthetic oligonucleotide
acctgtcgtctgttcctccc

SEQ ID NO: 653 - DNA, 20 bp, Artificial Sequence
  Description of Artificial Sequence: Synthetic oligonucleotide
attggggttttcccgtgccc

SEQ ID NO: 654 - DNA, 20 bp, Artificial Sequence
  Description of Artificial Sequence: Synthetic oligonucleotide
cactgtcgtctgttcgtccc

SEQ ID NO: 655 - DNA, 19 bp, Artificial Sequence
  Description of Artificial Sequence: Synthetic oligonucleotide
cctgtcgtcttttcgtccc

SEQ ID NO: 656 - DNA, 20 bp, Artificial Sequence
  Description of Artificial Sequence: Synthetic oligonucleotide
cctgtcttctggttcgtccc

SEQ ID NO: 657 - DNA, 19 bp, Artificial Sequence
  Description of Artificial Sequence: Synthetic oligonucleotide
cgactcggtctgcactccc

SEQ ID NO: 658 - DNA, 20 bp, Artificial Sequence
  Description of Artificial Sequence: Synthetic oligonucleotide
cgagcttctggtatcgtccc

SEQ ID NO: 659 - DNA, 20 bp, Artificial Sequence
  Description of Artificial Sequence: Synthetic oligonucleotide
cgagttcctctgatcgtccc

SEQ ID NO: 660 - DNA, 20 bp, Artificial Sequence
  Description of Artificial Sequence: Synthetic oligonucleotide
cgcgtcttctgctcactccc

SEQ ID NO: 661 - DNA, 20 bp, Artificial Sequence
  Description of Artificial Sequence: Synthetic oligonucleotide
cgtactcgtctgctcttccc

SEQ ID NO: 662 - DNA, 19 bp, Artificial Sequence
  Description of Artificial Sequence: Synthetic oligonucleotide
cgtttcctctggttcgtcc

SEQ ID NO: 663 - DNA, 20 bp, Artificial Sequence
  Description of Artificial Sequence: Synthetic oligonucleotide
cgttttctctggttcgtccc

SEQ ID NO: 664 - DNA, 20 bp, Artificial Sequence
  Description of Artificial Sequence: Synthetic oligonucleotide
gcctctcgtctgtgcctccc

SEQ ID NO: 665 - DNA, 20 bp, Artificial Sequence
  Description of Artificial Sequence: Synthetic oligonucleotide
gcctctgtcgtcactgtccc

SEQ ID NO: 666 - DNA, 19 bp, Artificial Sequence
  Description of Artificial Sequence: Synthetic oligonucleotide
gcgtttcctctgttcgtcc

SEQ ID NO: 667 - DNA, 20 bp, Artificial Sequence
  Description of Artificial Sequence: Synthetic oligonucleotide
gcgtttcttctgttcgtccc

SEQ ID NO: 668 - DNA, 20 bp, Artificial Sequence
  Description of Artificial Sequence: Synthetic oligonucleotide
gcttttcgtctacggtcccc

SEQ ID NO: 669 - DNA, 20 bp, Artificial Sequence
  Description of Artificial Sequence: Synthetic oligonucleotide
ggtttcgtctgccacctccc

SEQ ID NO: 670 - DNA, 21 bp, Artificial Sequence
  Description of Artificial Sequence: Synthetic oligonucleotide
gtcttgtcgtctgttcgtccc

SEQ ID NO: 671 - DNA, 20 bp, Artificial Sequence
  Description of Artificial Sequence: Synthetic oligonucleotide
gtgcctcgtctgctcttccc

SEQ ID NO: 672 - DNA, 20 bp, Artificial Sequence
  Description of Artificial Sequence: Synthetic oligonucleotide
tcatgtcgtctgttagtcac

SEQ ID NO: 673 - DNA, 20 bp, Artificial Sequence
  Description of Artificial Sequence: Synthetic oligonucleotide
tcatgtcgtctgttcgtcac

SEQ ID NO: 674 - DNA, 20 bp, Artificial Sequence
  Description of Artificial Sequence: Synthetic oligonucleotide
tcccgtcgcctgttcgtccc

SEQ ID NO: 675 - DNA, 20 bp, Artificial Sequence
  Description of Artificial Sequence: Synthetic oligonucleotide
tcccgtcgtctgttcgcccc

SEQ ID NO: 676 - DNA, 21 bp, Artificial Sequence
  Description of Artificial Sequence: Synthetic oligonucleotide
tccctgtcgtctgttcgtccc

SEQ ID NO: 677 - DNA, 20 bp, Artificial Sequence
  Description of Artificial Sequence: Synthetic oligonucleotide
tcctgccgtctgttcgcccc

SEQ ID NO: 678 - DNA, 20 bp, Artificial Sequence
  Description of Artificial Sequence: Synthetic oligonucleotide
tcctggcttgtcgttgtgcc

SEQ ID NO: 679 - DNA, 20 bp, Artificial Sequence
  Description of Artificial Sequence: Synthetic oligonucleotide
tcctgtcgtctgtccctccc

SEQ ID NO: 680 - DNA, 20 bp, Artificial Sequence
  Description of Artificial Sequence: Synthetic oligonucleotide
tcctgtcgtctgttcgcttc

SEQ ID NO: 681 - DNA, 20 bp, Artificial Sequence
  Description of Artificial Sequence: Synthetic oligonucleotide
tcgtctcgtctgccgctccc

SEQ ID NO: 682 - DNA, 20 bp, Artificial Sequence
  Description of Artificial Sequence: Synthetic oligonucleotide
tctcacattttcccggtgtg

SEQ ID NO: 683 - DNA, 20 bp, Artificial Sequence
  Description of Artificial Sequence: Synthetic oligonucleotide
tcttgtcgtctgttcttccc

SEQ ID NO: 684 - DNA, 20 bp, Artificial Sequence
  Description of Artificial Sequence: Synthetic oligonucleotide
tgcggtctctgatacctccc

SEQ ID NO: 685 - DNA, 20 bp, Artificial Sequence
  Description of Artificial Sequence: Synthetic oligonucleotide
tgctgtcgtctgctcgtccc

SEQ ID NO: 686 - DNA, 20 bp, Artificial Sequence
  Description of Artificial Sequence: Synthetic oligonucleotide
tgctgtcgtctgttcctccc

SEQ ID NO: 687 - DNA, 20 bp, Artificial Sequence
  Description of Artificial Sequence: Synthetic oligonucleotide
tgtctcgtctggagccgcac

SEQ ID NO: 688 - DNA, 20 bp, Artificial Sequence
  Description of Artificial Sequence: Synthetic oligonucleotide
ttgtagttgtctgcgctccc

SEQ ID NO: 689 - DNA, 20 bp, Artificial Sequence
  Description of Artificial Sequence: Synthetic oligonucleotide
tttcagtagtgggcctgctg

SEQ ID NO: 690 - DNA, 20 bp, Artificial Sequence
  Description of Artificial Sequence: Synthetic oligonucleotide
ccagtttaccttacactcgc

SEQ ID NO: 691 - DNA, 20 bp, Artificial Sequence
  Description of Artificial Sequence: Synthetic oligonucleotide
cccgtcgtctgttcactccc

SEQ ID NO: 692 - DNA, 20 bp, Artificial Sequence
  Description of Artificial Sequence: Synthetic oligonucleotide
ccctgtcgtctgatcgtccc

SEQ ID NO: 693 - DNA, 20 bp, Artificial Sequence
  Description of Artificial Sequence: Synthetic oligonucleotide
ccgtcgttctgtagcctccc

SEQ ID NO: 694 - DNA, 20 bp, Artificial Sequence
  Description of Artificial Sequence: Synthetic oligonucleotide
cctgtcgtcatttgcgtccc

SEQ ID NO: 695 - DNA, 20 bp, Artificial Sequence
  Description of Artificial Sequence: Synthetic oligonucleotide
cgactcctctgttttctccc

SEQ ID NO: 696 - DNA, 20 bp, Artificial Sequence
  Description of Artificial Sequence: Synthetic oligonucleotide
cgactcgttctgttcgtccc

SEQ ID NO: 697 - DNA, 20 bp, Artificial Sequence
  Description of Artificial Sequence: Synthetic oligonucleotide
cgattcctctgactcgtccc

SEQ ID NO: 698 - DNA, 20 bp, Artificial Sequence
  Description of Artificial Sequence: Synthetic oligonucleotide
cgcttcttctggagcctccc

SEQ ID NO: 699 - DNA, 20 bp, Artificial Sequence
  Description of Artificial Sequence: Synthetic oligonucleotide
cgggccttctgtttcgtccc

SEQ ID NO: 700 - DNA, 20 bp, Artificial Sequence
  Description of Artificial Sequence: Synthetic oligonucleotide
cgttactcgtctgtggccgc

SEQ ID NO: 701 - DNA, 20 bp, Artificial Sequence
  Description of Artificial Sequence: Synthetic oligonucleotide
cgtttcagtctgtagctccc

SEQ ID NO: 702 - DNA, 20 bp, Artificial Sequence
  Description of Artificial Sequence: Synthetic oligonucleotide
cgtttcctctggtttgtccc

SEQ ID NO: 703 - DNA, 20 bp, Artificial Sequence
  Description of Artificial Sequence: Synthetic oligonucleotide
cgtttcgtcttctgtcaccc

SEQ ID NO: 704 - DNA, 20 bp, Artificial Sequence
  Description of Artificial Sequence: Synthetic oligonucleotide
ctagtcttctgattcgtccc

SEQ ID NO: 705 - DNA, 20 bp, Artificial Sequence
  Description of Artificial Sequence: Synthetic oligonucleotide
gcaatcgttctgaccctccc

SEQ ID NO: 706 - DNA, 20 bp, Artificial Sequence
  Description of Artificial Sequence: Synthetic oligonucleotide
gcatttcgttctgatctccc

SEQ ID NO: 707 - DNA, 21 bp, Artificial Sequence
  Description of Artificial Sequence: Synthetic oligonucleotide
gcccgttcgtctttcctcccc

SEQ ID NO: 708 - DNA, 20 bp, Artificial Sequence
  Description of Artificial Sequence: Synthetic oligonucleotide
gcccttcgatctgcgctccc

SEQ ID NO: 709 - DNA, 20 bp, Artificial Sequence
  Description of Artificial Sequence: Synthetic oligonucleotide
gccgtcgttcttttcgtccc

SEQ ID NO: 710 - DNA, 20 bp, Artificial Sequence
  Description of Artificial Sequence: Synthetic oligonucleotide
gcctctcttctggacctccc

SEQ ID NO: 711 - DNA, 21 bp, Artificial Sequence
  Description of Artificial Sequence: Synthetic oligonucleotide
gccttctcgtctgttgtcccc

SEQ ID NO: 712 - DNA, 20 bp, Artificial Sequence
  Description of Artificial Sequence: Synthetic oligonucleotide
gcctttcgtctttacgtccc

SEQ ID NO: 713 - DNA, 20 bp, Artificial Sequence
  Description of Artificial Sequence: Synthetic oligonucleotide
gcgtctcttctgtccctccc

SEQ ID NO: 714 - DNA, 20 bp, Artificial Sequence
  Description of Artificial Sequence: Synthetic oligonucleotide
gcgtttcctctgttcgtctc

SEQ ID NO: 715 - DNA, 20 bp, Artificial Sequence
  Description of Artificial Sequence: Synthetic oligonucleotide
gcgtttcctctgttcgtttc

SEQ ID NO: 716 - DNA, 20 bp, Artificial Sequence
  Description of Artificial Sequence: Synthetic oligonucleotide
gctcgagcgtctttcgtccc

SEQ ID NO: 717 - DNA, 19 bp, Artificial Sequence
  Description of Artificial Sequence: Synthetic oligonucleotide
gctgtcttctgttcgtccc

SEQ ID NO: 718 - DNA, 20 bp, Artificial Sequence
  Description of Artificial Sequence: Synthetic oligonucleotide
gctttttcgtcttgcctccc

SEQ ID NO: 719 - DNA, 21 bp, Artificial Sequence
  Description of Artificial Sequence: Synthetic oligonucleotide
gtcctgacgtctgttcgtccc

SEQ ID NO: 720 - DNA, 21 bp, Artificial Sequence
  Description of Artificial Sequence: Synthetic oligonucleotide
gtcctgtcctctgttcgtccc

SEQ ID NO: 721 - DNA, 21 bp, Artificial Sequence
  Description of Artificial Sequence: Synthetic oligonucleotide
gtcctgtcgtcagttcgtccc

SEQ ID NO: 722 - DNA, 21 bp, Artificial Sequence
  Description of Artificial Sequence: Synthetic oligonucleotide
gtcctgtcgtctgttcgaccc

SEQ ID NO: 723 - DNA, 20 bp, Artificial Sequence
  Description of Artificial Sequence: Synthetic oligonucleotide
gtcctgtcgtctttcgtccc

SEQ ID NO: 724 - DNA, 20 bp, Artificial Sequence
  Description of Artificial Sequence: Synthetic oligonucleotide
gtcctttcgtctgtggccgc

SEQ ID NO: 725 - DNA, 20 bp, Artificial Sequence
  Description of Artificial Sequence: Synthetic oligonucleotide
gttgaatcgtctcgcgtccc

SEQ ID NO: 726 - DNA, 20 bp, Artificial Sequence
  Description of Artificial Sequence: Synthetic oligonucleotide
tcatgtcgtctgttcgttcc

SEQ ID NO: 727 - DNA, 20 bp, Artificial Sequence
  Description of Artificial Sequence: Synthetic oligonucleotide
tcccgtcgtctgttcgttcc

SEQ ID NO: 728 - DNA, 20 bp, Artificial Sequence
  Description of Artificial Sequence: Synthetic oligonucleotide
tcctatcgtctgttcgcccc

SEQ ID NO: 729 - DNA, 20 bp, Artificial Sequence
  Description of Artificial Sequence: Synthetic oligonucleotide
tcctcgcttgtcgttgtccc

SEQ ID NO: 730 - DNA, 20 bp, Artificial Sequence
  Description of Artificial Sequence: Synthetic oligonucleotide
tcctggcttctcgttgtccc

SEQ ID NO: 731 - DNA, 17 bp, Artificial Sequence
  Description of Artificial Sequence: Synthetic oligonucleotide
tcctggcttgtcgttcc

SEQ ID NO: 732 - DNA, 20 bp, Artificial Sequence
  Description of Artificial Sequence: Synthetic oligonucleotide
tcctgtcgtatgttcgtaca

SEQ ID NO: 733 - DNA, 20 bp, Artificial Sequence
  Description of Artificial Sequence: Synthetic oligonucleotide
tcctgtcgtatgttcgttcc

SEQ ID NO: 734 - DNA, 20 bp, Artificial Sequence
  Description of Artificial Sequence: Synthetic oligonucleotide
tcctgtcgtccgttcgttcc

SEQ ID NO: 735 - DNA, 20 bp, Artificial Sequence
  Description of Artificial Sequence: Synthetic oligonucleotide
tcctgtcgtctgctcttccc

SEQ ID NO: 736 - DNA, 22 bp, Artificial Sequence
  Description of Artificial Sequence: Synthetic oligonucleotide
tcctgtcgtctgttcgtccccc

SEQ ID NO: 737 - DNA, 19 bp, Artificial Sequence
  Description of Artificial Sequence: Synthetic oligonucleotide
tcctgtcgtctgttgttcc

SEQ ID NO: 738 - DNA, 20 bp, Artificial Sequence
  Description of Artificial Sequence: Synthetic oligonucleotide
tcctgtcgtcttctcgtccc

SEQ ID NO: 739 - DNA, 20 bp, Artificial Sequence
  Description of Artificial Sequence: Synthetic oligonucleotide
tcgatctggttttgccgcgc

SEQ ID NO: 740 - DNA, 20 bp, Artificial Sequence
  Description of Artificial Sequence: Synthetic oligonucleotide
tcttgtcgtctcttcgtccc

SEQ ID NO: 741 - DNA, 20 bp, Artificial Sequence
  Description of Artificial Sequence: Synthetic oligonucleotide
tcttgtcgtctgttcgtctc

SEQ ID NO: 742 - DNA, 20 bp, Artificial Sequence
  Description of Artificial Sequence: Synthetic oligonucleotide
tcttgtcgtctgttggtccc

SEQ ID NO: 743 - DNA, 20 bp, Artificial Sequence
  Description of Artificial Sequence: Synthetic oligonucleotide
tgctgtcgtctgttcgtttc

SEQ ID NO: 744 - DNA, 20 bp, Artificial Sequence
  Description of Artificial Sequence: Synthetic oligonucleotide
tttagggttttcccgtgccc

SEQ ID NO: 745 - DNA, 18 bp, Artificial Sequence
  Description of Artificial Sequence: Synthetic oligonucleotide
tcctgtcgtctgtgtccc

SEQ ID NO: 746 - DNA, 20 bp, Artificial Sequence
  Description of Artificial Sequence: Synthetic oligonucleotide
tcttctgggttttggcgccc

SEQ ID NO: 747 - DNA, 18 bp, Artificial Sequence
  Description of Artificial Sequence: Synthetic oligonucleotide
tttggggttcccgtgccc

SEQ ID NO: 748 - DNA, 21 bp, Artificial Sequence
  Description of Artificial Sequence: Synthetic oligonucleotide
tttggggttcttcccgtgccc

SEQ ID NO: 749 - DNA, 20 bp, Artificial Sequence
  Description of Artificial Sequence: Synthetic oligonucleotide
tttggggttttcacgtgccc

SEQ ID NO: 750 - DNA, 20 bp, Artificial Sequence
  Description of Artificial Sequence: Synthetic oligonucleotide
ccttcgtctggtttctgccc

SEQ ID NO: 751 - DNA, 20 bp, Artificial Sequence
  Description of Artificial Sequence: Synthetic oligonucleotide
tctggtgtttgttcccgcgc

SEQ ID NO: 752 - DNA, 20 bp, Artificial Sequence
  Description of Artificial Sequence: Synthetic oligonucleotide
tttggggttacttcccgccc

SEQ ID NO: 753 - DNA, 20 bp, Artificial Sequence
  Description of Artificial Sequence: Synthetic oligonucleotide
tttggggtttccttccgccc

SEQ ID NO: 754 - DNA, 20 bp, Artificial Sequence
  Description of Artificial Sequence: Synthetic oligonucleotide
tctcacagatcccacctgtg

SEQ ID NO: 755 - DNA, 20 bp, Artificial Sequence
  Description of Artificial Sequence: Synthetic oligonucleotide
aacgagtcgttttcgcaccc

SEQ ID NO: 756 - DNA, 20 bp, Artificial Sequence
  Description of Artificial Sequence: Synthetic oligonucleotide
acctgtagtctgttcgtccc

SEQ ID NO: 757 - DNA, 20 bp, Artificial Sequence
  Description of Artificial Sequence: Synthetic oligonucleotide
ccactcgtctgtcacctccc

SEQ ID NO: 758 - DNA, 20 bp, Artificial Sequence
  Description of Artificial Sequence: Synthetic oligonucleotide
ccagtcctctgtttcctccc

SEQ ID NO: 759 - DNA, 20 bp, Artificial Sequence
  Description of Artificial Sequence: Synthetic oligonucleotide
cccgtcgtctgcttcttccc

SEQ ID NO: 760 - DNA, 20 bp, Artificial Sequence
  Description of Artificial Sequence: Synthetic oligonucleotide
ccctctcgtctgttcgtccc

SEQ ID NO: 761 - DNA, 20 bp, Artificial Sequence
  Description of Artificial Sequence: Synthetic oligonucleotide
ccctgtcgtatgttcgtccc

SEQ ID NO: 762 - DNA, 20 bp, Artificial Sequence
  Description of Artificial Sequence: Synthetic oligonucleotide
ccctgtcgtctgtacgtccc

SEQ ID NO: 763 - DNA, 20 bp, Artificial Sequence
  Description of Artificial Sequence: Synthetic oligonucleotide
ccctgtcgtcttttcgtccc

SEQ ID NO: 764 - DNA, 20 bp, Artificial Sequence
  Description of Artificial Sequence: Synthetic oligonucleotide
ccgagttcttctgtactccc

SEQ ID NO: 765 - DNA, 20 bp, Artificial Sequence
  Description of Artificial Sequence: Synthetic oligonucleotide
ccgtgttgttctggcctccc

SEQ ID NO: 766 - DNA, 20 bp, Artificial Sequence
  Description of Artificial Sequence: Synthetic oligonucleotide
cctgtcgtctcttccctccc

SEQ ID NO: 767 - DNA, 20 bp, Artificial Sequence
  Description of Artificial Sequence: Synthetic oligonucleotide
cgactcgtcaattccctccc

SEQ ID NO: 768 - DNA, 20 bp, Artificial Sequence
  Description of Artificial Sequence: Synthetic oligonucleotide
cgactcttctgtgcgctccc

SEQ ID NO: 769 - DNA, 20 bp, Artificial Sequence
  Description of Artificial Sequence: Synthetic oligonucleotide
cgacttcgtctgcacctccc

SEQ ID NO: 770 - DNA, 20 bp, Artificial Sequence
  Description of Artificial Sequence: Synthetic oligonucleotide
cgtactcgtctgctgctccc

SEQ ID NO: 771 - DNA, 20 bp, Artificial Sequence
  Description of Artificial Sequence: Synthetic oligonucleotide
cgtttcctctggttcgtctc

SEQ ID NO: 772 - DNA, 20 bp, Artificial Sequence
  Description of Artificial Sequence: Synthetic oligonucleotide
cgtttctcgtctgcactccc

SEQ ID NO: 773 - DNA, 20 bp, Artificial Sequence
  Description of Artificial Sequence: Synthetic oligonucleotide
cgtttctgtctgacactccc

SEQ ID NO: 774 - DNA, 20 bp, Artificial Sequence
  Description of Artificial Sequence: Synthetic oligonucleotide
gccactcgtcttttcgtccc

SEQ ID NO: 775 - DNA, 20 bp, Artificial Sequence
  Description of Artificial Sequence: Synthetic oligonucleotide
gcccgtcgttcttacctccc

SEQ ID NO: 776 - DNA, 20 bp, Artificial Sequence
  Description of Artificial Sequence: Synthetic oligonucleotide
gcctcgtcgtttgttctccc

SEQ ID NO: 777 - DNA, 20 bp, Artificial Sequence
  Description of Artificial Sequence: Synthetic oligonucleotide
gcctctcgtctgaccctccc

SEQ ID NO: 778 - DNA, 20 bp, Artificial Sequence
  Description of Artificial Sequence: Synthetic oligonucleotide
gcctctcgttctgacctccc

SEQ ID NO: 779 - DNA, 22 bp, Artificial Sequence
  Description of Artificial Sequence: Synthetic oligonucleotide
gccttctcgtctgttgttcccc

SEQ ID NO: 780 - DNA, 20 bp, Artificial Sequence
  Description of Artificial Sequence: Synthetic oligonucleotide
gcgccttcgtttgtactccc

SEQ ID NO: 781 - DNA, 20 bp, Artificial Sequence
  Description of Artificial Sequence: Synthetic oligonucleotide
gcgtttcctctgtttgtccc

SEQ ID NO: 782 - DNA, 20 bp, Artificial Sequence
  Description of Artificial Sequence: Synthetic oligonucleotide
gctctcgtcgtttgcctccc

SEQ ID NO: 783 - DNA, 21 bp, Artificial Sequence
  Description of Artificial Sequence: Synthetic oligonucleotide
gtcatgtcgtctgttcgtccc

SEQ ID NO: 784 - DNA, 21 bp, Artificial Sequence
  Description of Artificial Sequence: Synthetic oligonucleotide
gtcctgtcgtctgtacgtccc

SEQ ID NO: 785 - DNA, 21 bp, Artificial Sequence
  Description of Artificial Sequence: Synthetic oligonucleotide
gtcctgtcgtctgttcgtcac

SEQ ID NO: 786 - DNA, 21 bp, Artificial Sequence
  Description of Artificial Sequence: Synthetic oligonucleotide
gtcctgtcgtctgttcgtgcc

SEQ ID NO: 787 - DNA, 20 bp, Artificial Sequence
  Description of Artificial Sequence: Synthetic oligonucleotide
gtctgtcgtctctacgtccc

SEQ ID NO: 788 - DNA, 20 bp, Artificial Sequence
  Description of Artificial Sequence: Synthetic oligonucleotide
gtgactctctgtaacctccc

SEQ ID NO: 789 - DNA, 21 bp, Artificial Sequence
  Description of Artificial Sequence: Synthetic oligonucleotide
gtgttttcgtctcttcgtccc

SEQ ID NO: 790 - DNA, 20 bp, Artificial Sequence
  Description of Artificial Sequence: Synthetic oligonucleotide
gttactcgtctgccgctccc

SEQ ID NO: 791 - DNA, 20 bp, Artificial Sequence
  Description of Artificial Sequence: Synthetic oligonucleotide
gttcctcgtctgtccctccc

SEQ ID NO: 792 - DNA, 20 bp, Artificial Sequence
  Description of Artificial Sequence: Synthetic oligonucleotide
tactgtcgtctgttcgtaca

SEQ ID NO: 793 - DNA, 20 bp, Artificial Sequence
  Description of Artificial Sequence: Synthetic oligonucleotide
tcagtcgtctacttcgtccc

SEQ ID NO: 794 - DNA, 20 bp, Artificial Sequence
  Description of Artificial Sequence: Synthetic oligonucleotide
tcatgtagtctgttcgtacc

SEQ ID NO: 795 - DNA, 20 bp, Artificial Sequence
  Description of Artificial Sequence: Synthetic oligonucleotide
tcatgtcgtctgttcgaccc

SEQ ID NO: 796 - DNA, 20 bp, Artificial Sequence
  Description of Artificial Sequence: Synthetic oligonucleotide
tcccgtcgtctcttcgtccc

SEQ ID NO: 797 - DNA, 20 bp, Artificial Sequence
  Description of Artificial Sequence: Synthetic oligonucleotide
tcctatcgtctgtttgtccc

SEQ ID NO: 798 - DNA, 20 bp, Artificial Sequence
  Description of Artificial Sequence: Synthetic oligonucleotide
tcctctcgcctgttcgtccc

SEQ ID NO: 799 - DNA, 20 bp, Artificial Sequence
  Description of Artificial Sequence: Synthetic oligonucleotide
tcctggcttgtcattgtccc

SEQ ID NO: 800 - DNA, 20 bp, Artificial Sequence
  Description of Artificial Sequence: Synthetic oligonucleotide
tcctggcttgtccttgtccc

SEQ ID NO: 801 - DNA, 20 bp, Artificial Sequence
  Description of Artificial Sequence: Synthetic oligonucleotide
tcctggcttgtcgttgtcct

SEQ ID NO: 802 - DNA, 20 bp, Artificial Sequence
  Description of Artificial Sequence: Synthetic oligonucleotide
tcctgtagtatgttagtccc

SEQ ID NO: 803 - DNA, 19 bp, Artificial Sequence
  Description of Artificial Sequence: Synthetic oligonucleotide
tcctgtcgcctgttcgtcc

SEQ ID NO: 804 - DNA, 20 bp, Artificial Sequence
  Description of Artificial Sequence: Synthetic oligonucleotide
tcctgtcggttgttcgtccc

SEQ ID NO: 805 - DNA, 20 bp, Artificial Sequence
  Description of Artificial Sequence: Synthetic oligonucleotide
tcctgtcgtctattcgcccc

SEQ ID NO: 806 - DNA, 20 bp, Artificial Sequence
  Description of Artificial Sequence: Synthetic oligonucleotide
tcctgtcgtctgctcgcccc

SEQ ID NO: 807 - DNA, 19 bp, Artificial Sequence
  Description of Artificial Sequence: Synthetic oligonucleotide
tcctgtcgtctgtcttccc

SEQ ID NO: 808 - DNA, 20 bp, Artificial Sequence
  Description of Artificial Sequence: Synthetic oligonucleotide
tcctgtcgtctgttagttcc

SEQ ID NO: 809 - DNA, 20 bp, Artificial Sequence
  Description of Artificial Sequence: Synthetic oligonucleotide
tcctgtcgtctgttcgacac

SEQ ID NO: 810 - DNA, 19 bp, Artificial Sequence
  Description of Artificial Sequence: Synthetic oligonucleotide
tcctgtcgtctgttcgtct

SEQ ID NO: 811 - DNA, 17 bp, Artificial Sequence
  Description of Artificial Sequence: Synthetic oligonucleotide
tcctgtcgtctgttctc

SEQ ID NO: 812 - DNA, 20 bp, Artificial Sequence
  Description of Artificial Sequence: Synthetic oligonucleotide
tcctgtcgtctgttctcccc

SEQ ID NO: 813 - DNA, 20 bp, Artificial Sequence
  Description of Artificial Sequence: Synthetic oligonucleotide
tcctgtcgtctgtttgtcac

SEQ ID NO: 814 - DNA, 20 bp, Artificial Sequence
  Description of Artificial Sequence: Synthetic oligonucleotide
tcctgtcgtctgtttgtcca

SEQ ID NO: 815 - DNA, 20 bp, Artificial Sequence
  Description of Artificial Sequence: Synthetic oligonucleotide
tcctgtcgtcttttcttccc

SEQ ID NO: 816 - DNA, 20 bp, Artificial Sequence
  Description of Artificial Sequence: Synthetic oligonucleotide
tcgagcgtcttcttgtcccc

SEQ ID NO: 817 - DNA, 20 bp, Artificial Sequence
  Description of Artificial Sequence: Synthetic oligonucleotide
tcggctcgtctgctactccc

SEQ ID NO: 818 - DNA, 20 bp, Artificial Sequence
  Description of Artificial Sequence: Synthetic oligonucleotide
tctctgggatttcctgcccc

SEQ ID NO: 819 - DNA, 20 bp, Artificial Sequence
  Description of Artificial Sequence: Synthetic oligonucleotide
tcttgtcgtctgttcgtcct

SEQ ID NO: 820 - DNA, 20 bp, Artificial Sequence
  Description of Artificial Sequence: Synthetic oligonucleotide
tcttgtcgtttgttcgtccc

SEQ ID NO: 821 - DNA, 20 bp, Artificial Sequence
  Description of Artificial Sequence: Synthetic oligonucleotide
tgagccgttcccttcgtccc

SEQ ID NO: 822 - DNA, 20 bp, Artificial Sequence
  Description of Artificial Sequence: Synthetic oligonucleotide
tgagtcgttcctttcgtccc

SEQ ID NO: 823 - DNA, 20 bp, Artificial Sequence
  Description of Artificial Sequence: Synthetic oligonucleotide
tgatgtccgctcagtcgcta

SEQ ID NO: 824 - DNA, 20 bp, Artificial Sequence
  Description of Artificial Sequence: Synthetic oligonucleotide
tgcctgtcgtttgatgccgc

SEQ ID NO: 825 - DNA, 20 bp, Artificial Sequence
  Description of Artificial Sequence: Synthetic oligonucleotide
tgcctgttgtctgtggccgc

SEQ ID NO: 826 - DNA, 20 bp, Artificial Sequence
  Description of Artificial Sequence: Synthetic oligonucleotide
tgcgttgtctgtgccctccc

SEQ ID NO: 827 - DNA, 20 bp, Artificial Sequence
  Description of Artificial Sequence: Synthetic oligonucleotide
tgttgtcgtctgttcgtccc

SEQ ID NO: 828 - DNA, 20 bp, Artificial Sequence
  Description of Artificial Sequence: Synthetic oligonucleotide
ttagtcgtttgttgggccgc

SEQ ID NO: 829 - DNA, 18 bp, Artificial Sequence
  Description of Artificial Sequence: Synthetic oligonucleotide
tcctgtcgtctttgtccc

SEQ ID NO: 830 - DNA, 20 bp, Artificial Sequence
  Description of Artificial Sequence: Synthetic oligonucleotide
tcctgttgtctgtttgtccc

SEQ ID NO: 831 - DNA, 20 bp, Artificial Sequence
  Description of Artificial Sequence: Synthetic oligonucleotide
tttggggttttcccgtgcca

SEQ ID NO: 832 - DNA, 21 bp, Artificial Sequence
  Description of Artificial Sequence: Synthetic oligonucleotide
tttggggttttcccgtgcccc

SEQ ID NO: 833 - DNA, 20 bp, Artificial Sequence
  Description of Artificial Sequence: Synthetic oligonucleotide
tttggggtttttcccgtgcc

SEQ ID NO: 834 - DNA, 21 bp, Artificial Sequence
  Description of Artificial Sequence: Synthetic oligonucleotide
tttggggtttttcccgtcccc

SEQ ID NO: 835 - DNA, 20 bp, Artificial Sequence
  Description of Artificial Sequence: Synthetic oligonucleotide
acctgtcgtctgttcgtcac

SEQ ID NO: 836 - DNA, 20 bp, Artificial Sequence
  Description of Artificial Sequence: Synthetic oligonucleotide
acttgtcgtctgttcgtccc

SEQ ID NO: 837 - DNA, 21 bp, Artificial Sequence
  Description of Artificial Sequence: Synthetic oligonucleotide
attggggtttttcccgtgccc

SEQ ID NO: 838 - DNA, 20 bp, Artificial Sequence
  Description of Artificial Sequence: Synthetic oligonucleotide
ccagtcgttctgcgcctccc

SEQ ID NO: 839 - DNA, 20 bp, Artificial Sequence
  Description of Artificial Sequence: Synthetic oligonucleotide
ccctgtcgtctgttcgtcac

SEQ ID NO: 840 - DNA, 20 bp, Artificial Sequence
  Description of Artificial Sequence: Synthetic oligonucleotide
ccctgtcgtctgttcgtgcc

SEQ ID NO: 841 - DNA, 20 bp, Artificial Sequence
  Description of Artificial Sequence: Synthetic oligonucleotide
ccgagtcctctgatcgtccc

SEQ ID NO: 842 - DNA, 20 bp, Artificial Sequence
  Description of Artificial Sequence: Synthetic oligonucleotide
cctgtcgtctgtagcctccc

SEQ ID NO: 843 - DNA, 20 bp, Artificial Sequence
  Description of Artificial Sequence: Synthetic oligonucleotide
ccttcgtctgttcccctccc

SEQ ID NO: 844 - DNA, 20 bp, Artificial Sequence
  Description of Artificial Sequence: Synthetic oligonucleotide
cgaatcgttctgcaactccc

SEQ ID NO: 845 - DNA, 20 bp, Artificial Sequence
  Description of Artificial Sequence: Synthetic oligonucleotide
cgactcctctgtttcctccc

SEQ ID NO: 846 - DNA, 20 bp, Artificial Sequence
  Description of Artificial Sequence: Synthetic oligonucleotide
cgactctctgcttctctccc

SEQ ID NO: 847 - DNA, 20 bp, Artificial Sequence
  Description of Artificial Sequence: Synthetic oligonucleotide
cgattcgtctctctcgtccc

SEQ ID NO: 848 - DNA, 20 bp, Artificial Sequence
  Description of Artificial Sequence: Synthetic oligonucleotide
cgcctcgtctgtatgctccc

SEQ ID NO: 849 - DNA, 20 bp, Artificial Sequence
  Description of Artificial Sequence: Synthetic oligonucleotide
cgttccctctggttcgtccc

SEQ ID NO: 850 - DNA, 20 bp, Artificial Sequence
  Description of Artificial Sequence: Synthetic oligonucleotide
cgttcgttctggttcgtccc

SEQ ID NO: 851 - DNA, 20 bp, Artificial Sequence
  Description of Artificial Sequence: Synthetic oligonucleotide
cgtttcccctggttcgtccc

SEQ ID NO: 852 - DNA, 19 bp, Artificial Sequence
  Description of Artificial Sequence: Synthetic oligonucleotide
cgtttcctctgttcgtccc

SEQ ID NO: 853 - DNA, 20 bp, Artificial Sequence
  Description of Artificial Sequence: Synthetic oligonucleotide
cgtttcctttggttcgtccc

SEQ ID NO: 854 - DNA, 20 bp, Artificial Sequence
  Description of Artificial Sequence: Synthetic oligonucleotide
gagtttcctctgttcgtccc

SEQ ID NO: 855 - DNA, 20 bp, Artificial Sequence
  Description of Artificial Sequence: Synthetic oligonucleotide
gccatctcgtcttacgtccc

SEQ ID NO: 856 - DNA, 20 bp, Artificial Sequence
  Description of Artificial Sequence: Synthetic oligonucleotide
gccctcgtttgctgtcaccc

SEQ ID NO: 857 - DNA, 20 bp, Artificial Sequence
  Description of Artificial Sequence: Synthetic oligonucleotide
gcccttcgtctaagcctccc

SEQ ID NO: 858 - DNA, 20 bp, Artificial Sequence
  Description of Artificial Sequence: Synthetic oligonucleotide
gccgtttcgtctatcctccc

SEQ ID NO: 859 - DNA, 20 bp, Artificial Sequence
  Description of Artificial Sequence: Synthetic oligonucleotide
gcctctcgtctgttcctccc

SEQ ID NO: 860 - DNA, 20 bp, Artificial Sequence
  Description of Artificial Sequence: Synthetic oligonucleotide
gcctctcgtcttaagtcccc

SEQ ID NO: 861 - DNA, 20 bp, Artificial Sequence
  Description of Artificial Sequence: Synthetic oligonucleotide
gcgcattcgtcgtacgtccc

SEQ ID NO: 862 - DNA, 20 bp, Artificial Sequence
  Description of Artificial Sequence: Synthetic oligonucleotide
gcgtctctctgctgtctccc

SEQ ID NO: 863 - DNA, 20 bp, Artificial Sequence
  Description of Artificial Sequence: Synthetic oligonucleotide
ggatcgtctgattacctccc

SEQ ID NO: 864 - DNA, 18 bp, Artificial Sequence
  Description of Artificial Sequence: Synthetic oligonucleotide
gtcctgtcgtctcgtccc

SEQ ID NO: 865 - DNA, 20 bp, Artificial Sequence
  Description of Artificial Sequence: Synthetic oligonucleotide
gtcctgtcgtctgttcgttc

SEQ ID NO: 866 - DNA, 21 bp, Artificial Sequence
  Description of Artificial Sequence: Synthetic oligonucleotide
gtcctgtcgtctgttggtccc

SEQ ID NO: 867 - DNA, 20 bp, Artificial Sequence
  Description of Artificial Sequence: Synthetic oligonucleotide
gtgattcctctgcccttccc

SEQ ID NO: 868 - DNA, 20 bp, Artificial Sequence
  Description of Artificial Sequence: Synthetic oligonucleotide
tactgtcgtctgttagtacc

SEQ ID NO: 869 - DNA, 20 bp, Artificial Sequence
  Description of Artificial Sequence: Synthetic oligonucleotide
tcatgtcgtctgttcgtctc

SEQ ID NO: 870 - DNA, 20 bp, Artificial Sequence
  Description of Artificial Sequence: Synthetic oligonucleotide
tccaggcttgtcgttgtccc

SEQ ID NO: 871 - DNA, 19 bp, Artificial Sequence
  Description of Artificial Sequence: Synthetic oligonucleotide
tccagtcgtttgttgccgc

SEQ ID NO: 872 - DNA, 20 bp, Artificial Sequence
  Description of Artificial Sequence: Synthetic oligonucleotide
tcccgtcgtccgttcgtccc

SEQ ID NO: 873 - DNA, 20 bp, Artificial Sequence
  Description of Artificial Sequence: Synthetic oligonucleotide
tcccgtcgtctgttcctccc

SEQ ID NO: 874 - DNA, 19 bp, Artificial Sequence
  Description of Artificial Sequence: Synthetic oligonucleotide
tcccgtcgtctgttcgtcc

SEQ ID NO: 875 - DNA, 19 bp, Artificial Sequence
  Description of Artificial Sequence: Synthetic oligonucleotide
tccggcttgtcgttgtccc

SEQ ID NO: 876 - DNA, 20 bp, Artificial Sequence
  Description of Artificial Sequence: Synthetic oligonucleotide
tcctatcgtccgttcgtccc

SEQ ID NO: 877 - DNA, 20 bp, Artificial Sequence
  Description of Artificial Sequence: Synthetic oligonucleotide
tcctgccgcctgttcgtccc

SEQ ID NO: 878 - DNA, 20 bp, Artificial Sequence
  Description of Artificial Sequence: Synthetic oligonucleotide
tcctgccgtccgttcgtccc

SEQ ID NO: 879 - DNA, 20 bp, Artificial Sequence
  Description of Artificial Sequence: Synthetic oligonucleotide
tcctggcatgtcgttgtccc

SEQ ID NO: 880 - DNA, 17 bp, Artificial Sequence
  Description of Artificial Sequence: Synthetic oligonucleotide
tcctggcttgtcgtccc

SEQ ID NO: 881 - DNA, 20 bp, Artificial Sequence
  Description of Artificial Sequence: Synthetic oligonucleotide
tcctggcttgtcgttggttc

SEQ ID NO: 882 - DNA, 20 bp, Artificial Sequence
  Description of Artificial Sequence: Synthetic oligonucleotide
tcctggcttgtggttgtccc

SEQ ID NO: 883 - DNA, 20 bp, Artificial Sequence
  Description of Artificial Sequence: Synthetic oligonucleotide
tcctgtcgcctgttcgtttc

SEQ ID NO: 884 - DNA, 20 bp, Artificial Sequence
  Description of Artificial Sequence: Synthetic oligonucleotide
tcctgtcgtatgttagtacc

SEQ ID NO: 885 - DNA, 20 bp, Artificial Sequence
  Description of Artificial Sequence: Synthetic oligonucleotide
tcctgtcgtatgttagtcac

SEQ ID NO: 886 - DNA, 20 bp, Artificial Sequence
  Description of Artificial Sequence: Synthetic oligonucleotide
tcctgtcgtatgttagtcca

SEQ ID NO: 887 - DNA, 20 bp, Artificial Sequence
  Description of Artificial Sequence: Synthetic oligonucleotide
tcctgtcgtccgtccgtccc

SEQ ID NO: 888 - DNA, 20 bp, Artificial Sequence
  Description of Artificial Sequence: Synthetic oligonucleotide
tcctgtcgtctgatcgttcc

SEQ ID NO: 889 - DNA, 20 bp, Artificial Sequence
  Description of Artificial Sequence: Synthetic oligonucleotide
tcctgtcgtctgtatgtccc

SEQ ID NO: 890 - DNA, 19 bp, Artificial Sequence
  Description of Artificial Sequence: Synthetic oligonucleotide
tcctgtcgtctgtcgttcc

SEQ ID NO: 891 - DNA, 20 bp, Artificial Sequence
  Description of Artificial Sequence: Synthetic oligonucleotide
tcctgtcgtctgttcctttc

SEQ ID NO: 892 - DNA, 20 bp, Artificial Sequence
  Description of Artificial Sequence: Synthetic oligonucleotide
tcctgtcgtctgttcgaacc

SEQ ID NO: 893 - DNA, 19 bp, Artificial Sequence
  Description of Artificial Sequence: Synthetic oligonucleotide
tcctgtcgtctgttcgtcg

SEQ ID NO: 894 - DNA, 19 bp, Artificial Sequence
  Description of Artificial Sequence: Synthetic oligonucleotide
tcctgtcgtctgttgtttc

SEQ ID NO: 895 - DNA, 20 bp, Artificial Sequence
  Description of Artificial Sequence: Synthetic oligonucleotide
tcctgtcgtctgtttgtcct

SEQ ID NO: 896 - DNA, 20 bp, Artificial Sequence
  Description of Artificial Sequence: Synthetic oligonucleotide
tcctgtcgtctgtttgtctc

SEQ ID NO: 897 - DNA, 20 bp, Artificial Sequence
  Description of Artificial Sequence: Synthetic oligonucleotide
tcctgtcgtcttttcgtacc

SEQ ID NO: 898 - DNA, 20 bp, Artificial Sequence
  Description of Artificial Sequence: Synthetic oligonucleotide
tcctgtcttcttttcgtccc

SEQ ID NO: 899 - DNA, 20 bp, Artificial Sequence
  Description of Artificial Sequence: Synthetic oligonucleotide
tcctgtcttgtcgttgtccc

SEQ ID NO: 900 - DNA, 20 bp, Artificial Sequence
  Description of Artificial Sequence: Synthetic oligonucleotide
tcctgttgtctgttcgtacc

SEQ ID NO: 901 - DNA, 20 bp, Artificial Sequence
  Description of Artificial Sequence: Synthetic oligonucleotide
tcctgttgtttgttcgtccc

SEQ ID NO: 902 - DNA, 20 bp, Artificial Sequence
  Description of Artificial Sequence: Synthetic oligonucleotide
tcgtgtcgtttgttcgtccc

SEQ ID NO: 903 - DNA, 20 bp, Artificial Sequence
  Description of Artificial Sequence: Synthetic oligonucleotide
tcgtgttgtctgttcgtccc

SEQ ID NO: 904 - DNA, 20 bp, Artificial Sequence
  Description of Artificial Sequence: Synthetic oligonucleotide
tctctgggtttttgccgccc

SEQ ID NO: 905 - DNA, 19 bp, Artificial Sequence
  Description of Artificial Sequence: Synthetic oligonucleotide
tctggcttgtcgttgtccc

SEQ ID NO: 906 - DNA, 19 bp, Artificial Sequence
  Description of Artificial Sequence: Synthetic oligonucleotide
tcttgtcgtctgtcgtccc

SEQ ID NO: 907 - DNA, 19 bp, Artificial Sequence
  Description of Artificial Sequence: Synthetic oligonucleotide
tgactcgtctgttcgtccc

SEQ ID NO: 908 - DNA, 20 bp, Artificial Sequence
  Description of Artificial Sequence: Synthetic oligonucleotide
tgagtcgctcccttcgtccc

SEQ ID NO: 909 - DNA, 20 bp, Artificial Sequence
  Description of Artificial Sequence: Synthetic oligonucleotide
ttgactcgtctgcgcctccc

SEQ ID NO: 910 - DNA, 20 bp, Artificial Sequence
  Description of Artificial Sequence: Synthetic oligonucleotide
tttggggttttcccttgccc

SEQ ID NO: 911 - DNA, 21 bp, Artificial Sequence
  Description of Artificial Sequence: Synthetic oligonucleotide
tttggggttttcttcccgccc

SEQ ID NO: 912 - DNA, 22 bp, Artificial Sequence
  Description of Artificial Sequence: Synthetic oligonucleotide
ttttggggtttttcccgtgccc

SEQ ID NO: 913 - DNA, 21 bp, Artificial Sequence
  Description of Artificial Sequence: Synthetic oligonucleotide
cttggggtttttcccgtgccc

SEQ ID NO: 914 - DNA, 20 bp, Artificial Sequence
  Description of Artificial Sequence: Synthetic oligonucleotide
tcagcacatttcccggtgtg

SEQ ID NO: 915 - DNA, 20 bp, Artificial Sequence
  Description of Artificial Sequence: Synthetic oligonucleotide
tttggggtttttccctgccc

SEQ ID NO: 916 - DNA, 20 bp, Artificial Sequence
  Description of Artificial Sequence: Synthetic oligonucleotide
agcgactcttctggcctccc

SEQ ID NO: 917 - DNA, 20 bp, Artificial Sequence
  Description of Artificial Sequence: Synthetic oligonucleotide
cacagttcgtctgcactccc

SEQ ID NO: 918 - DNA, 20 bp, Artificial Sequence
  Description of Artificial Sequence: Synthetic oligonucleotide
ccctgtcgtctgctcttccc

SEQ ID NO: 919 - DNA, 20 bp, Artificial Sequence
  Description of Artificial Sequence: Synthetic oligonucleotide
ccctgtcttctgttcgtccc

SEQ ID NO: 920 - DNA, 20 bp, Artificial Sequence
  Description of Artificial Sequence: Synthetic oligonucleotide
cccttcgtctgattctcccc

SEQ ID NO: 921 - DNA, 20 bp, Artificial Sequence
  Description of Artificial Sequence: Synthetic oligonucleotide
ccctttcgtctgaacctccc

SEQ ID NO: 922 - DNA, 20 bp, Artificial Sequence
  Description of Artificial Sequence: Synthetic oligonucleotide
cctgtcgtctattccctccc

SEQ ID NO: 923 - DNA, 19 bp, Artificial Sequence
  Description of Artificial Sequence: Synthetic oligonucleotide
cctgtcgtctgctcgtccc

SEQ ID NO: 924 - DNA, 19 bp, Artificial Sequence
  Description of Artificial Sequence: Synthetic oligonucleotide
cctgtcgtctgttcgttcc

SEQ ID NO: 925 - DNA, 19 bp, Artificial Sequence
  Description of Artificial Sequence: Synthetic oligonucleotide
cctgtcgtctgttcgtttc

SEQ ID NO: 926 - DNA, 20 bp, Artificial Sequence
  Description of Artificial Sequence: Synthetic oligonucleotide
cctgtcgttctgctcctccc

SEQ ID NO: 927 - DNA, 20 bp, Artificial Sequence
  Description of Artificial Sequence: Synthetic oligonucleotide
cctttcgtctggctcgtccc

SEQ ID NO: 928 - DNA, 20 bp, Artificial Sequence
  Description of Artificial Sequence: Synthetic oligonucleotide
cgacgtctgtctatcctccc

SEQ ID NO: 929 - DNA, 20 bp, Artificial Sequence
  Description of Artificial Sequence: Synthetic oligonucleotide
cgacgtctgttaccactccc

SEQ ID NO: 930 - DNA, 20 bp, Artificial Sequence
  Description of Artificial Sequence: Synthetic oligonucleotide
cgactcttctgcaccctccc

SEQ ID NO: 931 - DNA, 20 bp, Artificial Sequence
  Description of Artificial Sequence: Synthetic oligonucleotide
cgacttcgttctgtctcccc

SEQ ID NO: 932 - DNA, 20 bp, Artificial Sequence
  Description of Artificial Sequence: Synthetic oligonucleotide
cgagttctctgtgttctccc

SEQ ID NO: 933 - DNA, 20 bp, Artificial Sequence
  Description of Artificial Sequence: Synthetic oligonucleotide
cgatgtctctgcttcctccc

SEQ ID NO: 934 - DNA, 20 bp, Artificial Sequence
  Description of Artificial Sequence: Synthetic oligonucleotide
cgattcgatctttccgtccc

SEQ ID NO: 935 - DNA, 20 bp, Artificial Sequence
  Description of Artificial Sequence: Synthetic oligonucleotide
cgtctcgatctgccactccc

SEQ ID NO: 936 - DNA, 20 bp, Artificial Sequence
  Description of Artificial Sequence: Synthetic oligonucleotide
cgtctcgtctgactcgtccc

SEQ ID NO: 937 - DNA, 20 bp, Artificial Sequence
  Description of Artificial Sequence: Synthetic oligonucleotide
cgtttcgtctttttcgtccc

SEQ ID NO: 938 - DNA, 20 bp, Artificial Sequence
  Description of Artificial Sequence: Synthetic oligonucleotide
ctgaagtcttctgcgctccc

SEQ ID NO: 939 - DNA, 20 bp, Artificial Sequence
  Description of Artificial Sequence: Synthetic oligonucleotide
gatagtcttctgtccctccc

SEQ ID NO: 940 - DNA, 20 bp, Artificial Sequence
  Description of Artificial Sequence: Synthetic oligonucleotide
gcaaatcgtttgcacctccc

SEQ ID NO: 941 - DNA, 20 bp, Artificial Sequence
  Description of Artificial Sequence: Synthetic oligonucleotide
gcaattcgttctggcctccc

SEQ ID NO: 942 - DNA, 20 bp, Artificial Sequence
  Description of Artificial Sequence: Synthetic oligonucleotide
gcagtcttctgtcgcgtccc

SEQ ID NO: 943 - DNA, 20 bp, Artificial Sequence
  Description of Artificial Sequence: Synthetic oligonucleotide
gccatgttgtctgacctccc

SEQ ID NO: 944 - DNA, 20 bp, Artificial Sequence
  Description of Artificial Sequence: Synthetic oligonucleotide
gcccgttgtctgttcgtccc

SEQ ID NO: 945 - DNA, 20 bp, Artificial Sequence
  Description of Artificial Sequence: Synthetic oligonucleotide
gcccttctgtctgtctcccc

SEQ ID NO: 946 - DNA, 20 bp, Artificial Sequence
  Description of Artificial Sequence: Synthetic oligonucleotide
gcctctcgtctgactctccc

SEQ ID NO: 947 - DNA, 20 bp, Artificial Sequence
  Description of Artificial Sequence: Synthetic oligonucleotide
gccttccgtctgctactccc

SEQ ID NO: 948 - DNA, 20 bp, Artificial Sequence
  Description of Artificial Sequence: Synthetic oligonucleotide
gccttcgtttgcacactccc

SEQ ID NO: 949 - DNA, 20 bp, Artificial Sequence
  Description of Artificial Sequence: Synthetic oligonucleotide
gcctttcgctctgacctccc

SEQ ID NO: 950 - DNA, 20 bp, Artificial Sequence
  Description of Artificial Sequence: Synthetic oligonucleotide
gcctttcgttctaacctccc

SEQ ID NO: 951 - DNA, 20 bp, Artificial Sequence
  Description of Artificial Sequence: Synthetic oligonucleotide
gcctttcgtttgtgcctccc

SEQ ID NO: 952 - DNA, 20 bp, Artificial Sequence
  Description of Artificial Sequence: Synthetic oligonucleotide
gcgatcctctgtctcctccc

SEQ ID NO: 953 - DNA, 21 bp, Artificial Sequence
  Description of Artificial Sequence: Synthetic oligonucleotide
gcgttttcctctgttcgtccc

SEQ ID NO: 954 - DNA, 20 bp, Artificial Sequence
  Description of Artificial Sequence: Synthetic oligonucleotide
gctgtcttctgtctcctccc

SEQ ID NO: 955 - DNA, 20 bp, Artificial Sequence
  Description of Artificial Sequence: Synthetic oligonucleotide
gctgttgttgtctgcctccc

SEQ ID NO: 956 - DNA, 20 bp, Artificial Sequence
  Description of Artificial Sequence: Synthetic oligonucleotide
gcttgcttctggttcgtccc

SEQ ID NO: 957 - DNA, 20 bp, Artificial Sequence
  Description of Artificial Sequence: Synthetic oligonucleotide
gcttgtcttctgctcgtccc

SEQ ID NO: 958 - DNA, 20 bp, Artificial Sequence
  Description of Artificial Sequence: Synthetic oligonucleotide
gcttgtcttctgtccgtccc

SEQ ID NO: 959 - DNA, 20 bp, Artificial Sequence
  Description of Artificial Sequence: Synthetic oligonucleotide
ggagtcctctgtatcctccc

SEQ ID NO: 960 - DNA, 21 bp, Artificial Sequence
  Description of Artificial Sequence: Synthetic oligonucleotide
gtcctgtcgtatgttcgtccc

SEQ ID NO: 961 - DNA, 18 bp, Artificial Sequence
  Description of Artificial Sequence: Synthetic oligonucleotide
gtcctgtcgtctgttccc

SEQ ID NO: 962 - DNA, 21 bp, Artificial Sequence
  Description of Artificial Sequence: Synthetic oligonucleotide
gtcctgtcgtctgttcgtccg

SEQ ID NO: 963 - DNA, 21 bp, Artificial Sequence
  Description of Artificial Sequence: Synthetic oligonucleotide
gtcctgtcgtgtgttcgtccc

SEQ ID NO: 964 - DNA, 20 bp, Artificial Sequence
  Description of Artificial Sequence: Synthetic oligonucleotide
gtcgattcgtttgatgccgc

SEQ ID NO: 965 - DNA, 20 bp, Artificial Sequence
  Description of Artificial Sequence: Synthetic oligonucleotide
gtctgtcgtctgttcgtccc

SEQ ID NO: 966 - DNA, 20 bp, Artificial Sequence
  Description of Artificial Sequence: Synthetic oligonucleotide
taatgtagtatgttagtcac

SEQ ID NO: 967 - DNA, 21 bp, Artificial Sequence
  Description of Artificial Sequence: Synthetic oligonucleotide
tacctgtcgtctgttcgtccc

SEQ ID NO: 968 - DNA, 20 bp, Artificial Sequence
  Description of Artificial Sequence: Synthetic oligonucleotide
tcatgtagtctgttcgtcca

SEQ ID NO: 969 - DNA, 20 bp, Artificial Sequence
  Description of Artificial Sequence: Synthetic oligonucleotide
tcatgtcgtatgttcgtacc

SEQ ID NO: 970 - DNA, 20 bp, Artificial Sequence
  Description of Artificial Sequence: Synthetic oligonucleotide
tcatgtcgtctgtttgtccc

SEQ ID NO: 971 - DNA, 20 bp, Artificial Sequence
  Description of Artificial Sequence: Synthetic oligonucleotide
tccagtcgtctgttcgtacc

SEQ ID NO: 972 - DNA, 20 bp, Artificial Sequence
  Description of Artificial Sequence: Synthetic oligonucleotide
tccagttgtctgctgctccc

SEQ ID NO: 973 - DNA, 20 bp, Artificial Sequence
  Description of Artificial Sequence: Synthetic oligonucleotide
tcccgtcgtctgtttgtccc

SEQ ID NO: 974 - DNA, 20 bp, Artificial Sequence
  Description of Artificial Sequence: Synthetic oligonucleotide
tcctatcgtctgctcgtccc

SEQ ID NO: 975 - DNA, 20 bp, Artificial Sequence
  Description of Artificial Sequence: Synthetic oligonucleotide
tcctggattgtcgttgtccc

SEQ ID NO: 976 - DNA, 20 bp, Artificial Sequence
  Description of Artificial Sequence: Synthetic oligonucleotide
tcctggcttatcgttgtccc

SEQ ID NO: 977 - DNA, 20 bp, Artificial Sequence
  Description of Artificial Sequence: Synthetic oligonucleotide
tcctggcttgacgttgtccc

SEQ ID NO: 978 - DNA, 20 bp, Artificial Sequence
  Description of Artificial Sequence: Synthetic oligonucleotide
tcctggcttgtagttgtccc

SEQ ID NO: 979 - DNA, 20 bp, Artificial Sequence
  Description of Artificial Sequence: Synthetic oligonucleotide
tcctggcttgtcgttggccc

SEQ ID NO: 980 - DNA, 20 bp, Artificial Sequence
  Description of Artificial Sequence: Synthetic oligonucleotide
tcctggcttgtcgttgtcac

SEQ ID NO: 981 - DNA, 20 bp, Artificial Sequence
  Description of Artificial Sequence: Synthetic oligonucleotide
tcctgtagtctgttagtacc

SEQ ID NO: 982 - DNA, 20 bp, Artificial Sequence
  Description of Artificial Sequence: Synthetic oligonucleotide
tcctgtagtctgttagtcca

SEQ ID NO: 983 - DNA, 20 bp, Artificial Sequence
  Description of Artificial Sequence: Synthetic oligonucleotide
tcctgtagtctgttcgtctc

SEQ ID NO: 984 - DNA, 20 bp, Artificial Sequence
  Description of Artificial Sequence: Synthetic oligonucleotide
tcctgtcatctgttcatccc

SEQ ID NO: 985 - DNA, 19 bp, Artificial Sequence
  Description of Artificial Sequence: Synthetic oligonucleotide
tcctgtcgccgttcgtccc

SEQ ID NO: 986 - DNA, 20 bp, Artificial Sequence
  Description of Artificial Sequence: Synthetic oligonucleotide
tcctgtcgcctgttcctccc

SEQ ID NO: 987 - DNA, 20 bp, Artificial Sequence
  Description of Artificial Sequence: Synthetic oligonucleotide
tcctgtcgcctgttcgttcc

SEQ ID NO: 988 - DNA, 20 bp, Artificial Sequence
  Description of Artificial Sequence: Synthetic oligonucleotide
tcctgtcgtatgttcgtctc

SEQ ID NO: 989 - DNA, 20 bp, Artificial Sequence
  Description of Artificial Sequence: Synthetic oligonucleotide
tcctgtcgtctattcgttcc

SEQ ID NO: 990 - DNA, 20 bp, Artificial Sequence
  Description of Artificial Sequence: Synthetic oligonucleotide
tcctgtcgtctcttcgttcc

SEQ ID NO: 991 - DNA, 20 bp, Artificial Sequence
  Description of Artificial Sequence: Synthetic oligonucleotide
tcctgtcgtctgatcatccc

SEQ ID NO: 992 - DNA, 20 bp, Artificial Sequence
  Description of Artificial Sequence: Synthetic oligonucleotide
tcctgtcgtctgtacgttcc

SEQ ID NO: 993 - DNA, 20 bp, Artificial Sequence
  Description of Artificial Sequence: Synthetic oligonucleotide
tcctgtcgtctgtccgttcc

SEQ ID NO: 994 - DNA, 20 bp, Artificial Sequence
  Description of Artificial Sequence: Synthetic oligonucleotide
tcctgtcgtctgtccgtttc

SEQ ID NO: 995 - DNA, 19 bp, Artificial Sequence
  Description of Artificial Sequence: Synthetic oligonucleotide
tcctgtcgtctgttcatcc

SEQ ID NO: 996 - DNA, 20 bp, Artificial Sequence
  Description of Artificial Sequence: Synthetic oligonucleotide
tcctgtcgtctgttcattcc

SEQ ID NO: 997 - DNA, 20 bp, Artificial Sequence
  Description of Artificial Sequence: Synthetic oligonucleotide
tcctgtcgtctgttcgacca

SEQ ID NO: 998 - DNA, 20 bp, Artificial Sequence
  Description of Artificial Sequence: Synthetic oligonucleotide
tcctgtcgtctgttcggacc

SEQ ID NO: 999 - DNA, 21 bp, Artificial Sequence
  Description of Artificial Sequence: Synthetic oligonucleotide
tcctgtcgtctgttcggtccc

SEQ ID NO: 1000 - DNA, 19 bp, Artificial Sequence
  Description of Artificial Sequence: Synthetic oligonucleotide
tcctgtcgtctgttcgtac

SEQ ID NO: 1001 - DNA, 20 bp, Artificial Sequence
  Description of Artificial Sequence: Synthetic oligonucleotide
tcctgtcgtctgttcgtcta

SEQ ID NO: 1002 - DNA, 20 bp, Artificial Sequence
  Description of Artificial Sequence: Synthetic oligonucleotide
tcctgtcgtctgttcgtctg

SEQ ID NO: 1003 - DNA, 20 bp, Artificial Sequence
  Description of Artificial Sequence: Synthetic oligonucleotide
tcctgtcgtctgttcgtttt

SEQ ID NO: 1004 - DNA, 19 bp, Artificial Sequence
  Description of Artificial Sequence: Synthetic oligonucleotide
tcctgtcgtctgtttgtcc

SEQ ID NO: 1005 - DNA, 19 bp, Artificial Sequence
  Description of Artificial Sequence: Synthetic oligonucleotide
tcctgtcgtcttacgtccc

SEQ ID NO: 1006 - DNA, 18 bp, Artificial Sequence
  Description of Artificial Sequence: Synthetic oligonucleotide
tcctgtcgtgttcgtccc

SEQ ID NO: 1007 - DNA, 20 bp, Artificial Sequence
  Description of Artificial Sequence: Synthetic oligonucleotide
tcctgtcgtttgttagtccc

SEQ ID NO: 1008 - DNA, 20 bp, Artificial Sequence
  Description of Artificial Sequence: Synthetic oligonucleotide
tcctgtcgtttgttcgcccc

SEQ ID NO: 1009 - DNA, 20 bp, Artificial Sequence
  Description of Artificial Sequence: Synthetic oligonucleotide
tcctgtcgtttgttcgtacc

SEQ ID NO: 1010 - DNA, 20 bp, Artificial Sequence
  Description of Artificial Sequence: Synthetic oligonucleotide
tcctttcgtttgttcgtccc

SEQ ID NO: 1011 - DNA, 20 bp, Artificial Sequence
  Description of Artificial Sequence: Synthetic oligonucleotide
tcgattcttctgtgtctccc

SEQ ID NO: 1012 - DNA, 18 bp, Artificial Sequence
  Description of Artificial Sequence: Synthetic oligonucleotide
tcgtcgtctgttcgtccc

SEQ ID NO: 1013 - DNA, 20 bp, Artificial Sequence
  Description of Artificial Sequence: Synthetic oligonucleotide
tcgttgtcgtctagcctccc

SEQ ID NO: 1014 - DNA, 20 bp, Artificial Sequence
  Description of Artificial Sequence: Synthetic oligonucleotide
tcttatcgtctgttcgtccc

SEQ ID NO: 1015 - DNA, 20 bp, Artificial Sequence
  Description of Artificial Sequence: Synthetic oligonucleotide
tcttggcttgtcgttgtccc

SEQ ID NO: 1016 - DNA, 20 bp, Artificial Sequence
  Description of Artificial Sequence: Synthetic oligonucleotide
tcttgtcgtctgatcgtccc

SEQ ID NO: 1017 - DNA, 20 bp, Artificial Sequence
  Description of Artificial Sequence: Synthetic oligonucleotide
tcttgtcgtctgttcgtcac

SEQ ID NO: 1018 - DNA, 20 bp, Artificial Sequence
  Description of Artificial Sequence: Synthetic oligonucleotide
tcttttcgtctgttcgtccc

SEQ ID NO: 1019 - DNA, 20 bp, Artificial Sequence
  Description of Artificial Sequence: Synthetic oligonucleotide
tgaagttcgtctgtgctccc

SEQ ID NO: 1020 - DNA, 20 bp, Artificial Sequence
  Description of Artificial Sequence: Synthetic oligonucleotide
tgagtcctctgtttcgtccc

SEQ ID NO: 1021 - DNA, 20 bp, Artificial Sequence
  Description of Artificial Sequence: Synthetic oligonucleotide
tgagtcgtccccttcgtccc

SEQ ID NO: 1022 - DNA, 19 bp, Artificial Sequence
  Description of Artificial Sequence: Synthetic oligonucleotide
tgagtcgttcccttcgtcc

SEQ ID NO: 1023 - DNA, 20 bp, Artificial Sequence
  Description of Artificial Sequence: Synthetic oligonucleotide
tgagtcgttcccttcgttcc

SEQ ID NO: 1024 - DNA, 20 bp, Artificial Sequence
  Description of Artificial Sequence: Synthetic oligonucleotide
tgagtcgttcccttcgtttc

SEQ ID NO: 1025 - DNA, 20 bp, Artificial Sequence
  Description of Artificial Sequence: Synthetic oligonucleotide
tgatgtcgtctttgcgtccc

SEQ ID NO: 1026 - DNA, 19 bp, Artificial Sequence
  Description of Artificial Sequence: Synthetic oligonucleotide
tgctgtcgtctgttcgtcc

SEQ ID NO: 1027 - DNA, 20 bp, Artificial Sequence
  Description of Artificial Sequence: Synthetic oligonucleotide
tgctgtcgtctgttcgttcc

SEQ ID NO: 1028 - DNA, 20 bp, Artificial Sequence
  Description of Artificial Sequence: Synthetic oligonucleotide
tgtgttgtctgttgcctccc

SEQ ID NO: 1029 - DNA, 20 bp, Artificial Sequence
  Description of Artificial Sequence: Synthetic oligonucleotide
tttgggattttcccgtgccc

SEQ ID NO: 1030 - DNA, 20 bp, Artificial Sequence
  Description of Artificial Sequence: Synthetic oligonucleotide
tttggggtctttccctgccc

SEQ ID NO: 1031 - DNA, 20 bp, Artificial Sequence
  Description of Artificial Sequence: Synthetic oligonucleotide
tttggggtttctccccgccc

SEQ ID NO: 1032 - DNA, 19 bp, Artificial Sequence
  Description of Artificial Sequence: Synthetic oligonucleotide
tttgtcgtctgttcgtccc

SEQ ID NO: 1033 - DNA, 20 bp, Artificial Sequence
  Description of Artificial Sequence: Synthetic oligonucleotide
atgtatgttgggggccacgc

SEQ ID NO: 1034 - DNA, 20 bp, Artificial Sequence
  Description of Artificial Sequence: Synthetic oligonucleotide
gccctcgtttggttcgtccc

SEQ ID NO: 1035 - DNA, 19 bp, Artificial Sequence
  Description of Artificial Sequence: Synthetic oligonucleotide
tcctgtcgtccgttcgtcc

SEQ ID NO: 1036 - DNA, 20 bp, Artificial Sequence
  Description of Artificial Sequence: Synthetic oligonucleotide
ttctgtcgtctgttcgtctc

SEQ ID NO: 1037 - DNA, 20 bp, Artificial Sequence
  Description of Artificial Sequence: Synthetic oligonucleotide
tttggggttttcccgtgctc

SEQ ID NO: 1038 - DNA, 19 bp, Artificial Sequence
  Description of Artificial Sequence: Synthetic oligonucleotide
tttggggtttttcgtgccc

SEQ ID NO: 1039 - DNA, 20 bp, Artificial Sequence
  Description of Artificial Sequence: Synthetic oligonucleotide
tatatgttcgtcactcgctg

SEQ ID NO: 1040 - DNA, 20 bp, Artificial Sequence
  Description of Artificial Sequence: Synthetic oligonucleotide
tctgacgagactcccatcgc

SEQ ID NO: 1041 - DNA, 20 bp, Artificial Sequence
  Description of Artificial Sequence: Synthetic oligonucleotide
tttggggtattcctcggccc

SEQ ID NO: 1042 - DNA, 20 bp, Artificial Sequence
  Description of Artificial Sequence: Synthetic oligonucleotide
tttgggtttttcccgtgccc

SEQ ID NO: 1043 - DNA, 20 bp, Artificial Sequence
  Description of Artificial Sequence: Synthetic oligonucleotide
tctacacagtgtcccgtgtg

SEQ ID NO: 1044 - DNA, 20 bp, Artificial Sequence
  Description of Artificial Sequence: Synthetic oligonucleotide
acctgacgtctgttcgtccc

SEQ ID NO: 1045 - DNA, 20 bp, Artificial Sequence
  Description of Artificial Sequence: Synthetic oligonucleotide
acctggcttgtcgttgtccc

SEQ ID NO: 1046 - DNA, 20 bp, Artificial Sequence
  Description of Artificial Sequence: Synthetic oligonucleotide
acctgtcgtctgatcgtccc

SEQ ID NO: 1047 - DNA, 20 bp, Artificial Sequence
  Description of Artificial Sequence: Synthetic oligonucleotide
acctgtcgtctgttcatccc

SEQ ID NO: 1048 - DNA, 20 bp, Artificial Sequence
  Description of Artificial Sequence: Synthetic oligonucleotide
accttgtcgtctgacctccc

SEQ ID NO: 1049 - DNA, 20 bp, Artificial Sequence
  Description of Artificial Sequence: Synthetic oligonucleotide
actcgtctggtttgccgcgc

SEQ ID NO: 1050 - DNA, 20 bp, Artificial Sequence
  Description of Artificial Sequence: Synthetic oligonucleotide
atatccagtctatggccccg

SEQ ID NO: 1051 - DNA, 20 bp, Artificial Sequence
  Description of Artificial Sequence: Synthetic oligonucleotide
atctggggttttccctgccc

SEQ ID NO: 1052 - DNA, 20 bp, Artificial Sequence
  Description of Artificial Sequence: Synthetic oligonucleotide
cacagttcgtctgcgctccc

SEQ ID NO: 1053 - DNA, 20 bp, Artificial Sequence
  Description of Artificial Sequence: Synthetic oligonucleotide
cagatcgtctgttgcctccc

SEQ ID NO: 1054 - DNA, 21 bp, Artificial Sequence
  Description of Artificial Sequence: Synthetic oligonucleotide
cagtcgtctttttttgtcccc

SEQ ID NO: 1055 - DNA, 20 bp, Artificial Sequence
  Description of Artificial Sequence: Synthetic oligonucleotide
ccagttgatctgtccctccc

SEQ ID NO: 1056 - DNA, 20 bp, Artificial Sequence
  Description of Artificial Sequence: Synthetic oligonucleotide
ccctgacgtctgttcgtccc

SEQ ID NO: 1057 - DNA, 20 bp, Artificial Sequence
  Description of Artificial Sequence: Synthetic oligonucleotide
ccctgtcgtctgttcgaccc

SEQ ID NO: 1058 - DNA, 20 bp, Artificial Sequence
  Description of Artificial Sequence: Synthetic oligonucleotide
ccctgtcgtctgttcggccc

SEQ ID NO: 1059 - DNA, 19 bp, Artificial Sequence
  Description of Artificial Sequence: Synthetic oligonucleotide
ccctgtcgtctgttcgttc

SEQ ID NO: 1060 - DNA, 21 bp, Artificial Sequence
  Description of Artificial Sequence: Synthetic oligonucleotide
ccctgtcgtctgttcgttccc

SEQ ID NO: 1061 - DNA, 20 bp, Artificial Sequence
  Description of Artificial Sequence: Synthetic oligonucleotide
ccctgtcgtctgttggtccc

SEQ ID NO: 1062 - DNA, 20 bp, Artificial Sequence
  Description of Artificial Sequence: Synthetic oligonucleotide
cccttcgtctgttctctccc

SEQ ID NO: 1063 - DNA, 20 bp, Artificial Sequence
  Description of Artificial Sequence: Synthetic oligonucleotide
ccgctctttccttccctccc

SEQ ID NO: 1064 - DNA, 20 bp, Artificial Sequence
  Description of Artificial Sequence: Synthetic oligonucleotide
ccgtcgtctgttgttctccc

SEQ ID NO: 1065 - DNA, 20 bp, Artificial Sequence
  Description of Artificial Sequence: Synthetic oligonucleotide
cctgtcgtcatgctgctccc

SEQ ID NO: 1066 - DNA, 22 bp, Artificial Sequence
  Description of Artificial Sequence: Synthetic oligonucleotide
cctgtcgtctttttttcgtccc

SEQ ID NO: 1067 - DNA, 20 bp, Artificial Sequence
  Description of Artificial Sequence: Synthetic oligonucleotide
cgacacgttctggacctccc

SEQ ID NO: 1068 - DNA, 20 bp, Artificial Sequence
  Description of Artificial Sequence: Synthetic oligonucleotide
cgacgatcgtctgacctccc

SEQ ID NO: 1069 - DNA, 20 bp, Artificial Sequence
  Description of Artificial Sequence: Synthetic oligonucleotide
cgacgtcttctgttcgtccc

SEQ ID NO: 1070 - DNA, 20 bp, Artificial Sequence
  Description of Artificial Sequence: Synthetic oligonucleotide
cgactcccgtctgtactccc

SEQ ID NO: 1071 - DNA, 20 bp, Artificial Sequence
  Description of Artificial Sequence: Synthetic oligonucleotide
cgactcgtcaacctcgtccc

SEQ ID NO: 1072 - DNA, 20 bp, Artificial Sequence
  Description of Artificial Sequence: Synthetic oligonucleotide
cgatactcgtttgcgctccc

SEQ ID NO: 1073 - DNA, 20 bp, Artificial Sequence
  Description of Artificial Sequence: Synthetic oligonucleotide
cgatcgatctgcctcttccc

SEQ ID NO: 1074 - DNA, 20 bp, Artificial Sequence
  Description of Artificial Sequence: Synthetic oligonucleotide
cgatcgttctgttacgtccc

SEQ ID NO: 1075 - DNA, 20 bp, Artificial Sequence
  Description of Artificial Sequence: Synthetic oligonucleotide
cgattctctgttcttctccc

SEQ ID NO: 1076 - DNA, 20 bp, Artificial Sequence
  Description of Artificial Sequence: Synthetic oligonucleotide
cgcgatcgtttgcacctccc

SEQ ID NO: 1077 - DNA, 20 bp, Artificial Sequence
  Description of Artificial Sequence: Synthetic oligonucleotide
cgcgttctctgtatcctccc

SEQ ID NO: 1078 - DNA, 20 bp, Artificial Sequence
  Description of Artificial Sequence: Synthetic oligonucleotide
cggtcgtttgatttcgtccc

SEQ ID NO: 1079 - DNA, 20 bp, Artificial Sequence
  Description of Artificial Sequence: Synthetic oligonucleotide
cgtttactctggttcgtccc

SEQ ID NO: 1080 - DNA, 20 bp, Artificial Sequence
  Description of Artificial Sequence: Synthetic oligonucleotide
cgtttcctctggttcatccc

SEQ ID NO: 1081 - DNA, 20 bp, Artificial Sequence
  Description of Artificial Sequence: Synthetic oligonucleotide
ctactcgtctgaaccctccc

SEQ ID NO: 1082 - DNA, 21 bp, Artificial Sequence
  Description of Artificial Sequence: Synthetic oligonucleotide
ctcctgtcgtctgttcgtccc

SEQ ID NO: 1083 - DNA, 20 bp, Artificial Sequence
  Description of Artificial Sequence: Synthetic oligonucleotide
ctcgagttgtctgccctccc

SEQ ID NO: 1084 - DNA, 20 bp, Artificial Sequence
  Description of Artificial Sequence: Synthetic oligonucleotide
ctgatttcgtctgacctccc

SEQ ID NO: 1085 - DNA, 20 bp, Artificial Sequence
  Description of Artificial Sequence: Synthetic oligonucleotide
ctgttccggctgcgttggtc

SEQ ID NO: 1086 - DNA, 20 bp, Artificial Sequence
  Description of Artificial Sequence: Synthetic oligonucleotide
cttgtcgatctgtgtgccgc

SEQ ID NO: 1087 - DNA, 20 bp, Artificial Sequence
  Description of Artificial Sequence: Synthetic oligonucleotide
cttgttgtctgatacctccc

SEQ ID NO: 1088 - DNA, 20 bp, Artificial Sequence
  Description of Artificial Sequence: Synthetic oligonucleotide
gaccttcgtctgctgctccc

SEQ ID NO: 1089 - DNA, 20 bp, Artificial Sequence
  Description of Artificial Sequence: Synthetic oligonucleotide
gcacgatcgtttgcactccc

SEQ ID NO: 1090 - DNA, 20 bp, Artificial Sequence
  Description of Artificial Sequence: Synthetic oligonucleotide
gcagcggtggtagtctatcc

SEQ ID NO: 1091 - DNA, 20 bp, Artificial Sequence
  Description of Artificial Sequence: Synthetic oligonucleotide
gccattcgtctgttcgtccc

SEQ ID NO: 1092 - DNA, 20 bp, Artificial Sequence
  Description of Artificial Sequence: Synthetic oligonucleotide
gccattcgtcttgcgtcccc

SEQ ID NO: 1093 - DNA, 20 bp, Artificial Sequence
  Description of Artificial Sequence: Synthetic oligonucleotide
gcccagttgtcttgcctccc

SEQ ID NO: 1094 - DNA, 20 bp, Artificial Sequence
  Description of Artificial Sequence: Synthetic oligonucleotide
gccctcgtcttttccctccc

SEQ ID NO: 1095 - DNA, 20 bp, Artificial Sequence
  Description of Artificial Sequence: Synthetic oligonucleotide
gccgagttctgtagccgcac

SEQ ID NO: 1096 - DNA, 20 bp, Artificial Sequence
  Description of Artificial Sequence: Synthetic oligonucleotide
gccgtcctttttcccctccc

SEQ ID NO: 1097 - DNA, 20 bp, Artificial Sequence
  Description of Artificial Sequence: Synthetic oligonucleotide
gcctcagtcgttctactccc

SEQ ID NO: 1098 - DNA, 20 bp, Artificial Sequence
  Description of Artificial Sequence: Synthetic oligonucleotide
gcctcgatctgttccctccc

SEQ ID NO: 1099 - DNA, 20 bp, Artificial Sequence
  Description of Artificial Sequence: Synthetic oligonucleotide
gcctctcgtctatccgtccc

SEQ ID NO: 1100 - DNA, 20 bp, Artificial Sequence
  Description of Artificial Sequence: Synthetic oligonucleotide
gcctctcgtctgcacctccc

SEQ ID NO: 1101 - DNA, 20 bp, Artificial Sequence
  Description of Artificial Sequence: Synthetic oligonucleotide
gcctctctgtctgcactccc

SEQ ID NO: 1102 - DNA, 20 bp, Artificial Sequence
  Description of Artificial Sequence: Synthetic oligonucleotide
gccttcgtttgtttcgtccc

SEQ ID NO: 1103 - DNA, 20 bp, Artificial Sequence
  Description of Artificial Sequence: Synthetic oligonucleotide
gccttctcgcctgttgtccc

SEQ ID NO: 1104 - DNA, 20 bp, Artificial Sequence
  Description of Artificial Sequence: Synthetic oligonucleotide
gccttctcgtctgatctccc

SEQ ID NO: 1105 - DNA, 20 bp, Artificial Sequence
  Description of Artificial Sequence: Synthetic oligonucleotide
gccttctcgtctgttgttcc

SEQ ID NO: 1106 - DNA, 20 bp, Artificial Sequence
  Description of Artificial Sequence: Synthetic oligonucleotide
gcctttcgttctgaccttcc

SEQ ID NO: 1107 - DNA, 20 bp, Artificial Sequence
  Description of Artificial Sequence: Synthetic oligonucleotide
gcctttctctggttcgtccc

SEQ ID NO: 1108 - DNA, 20 bp, Artificial Sequence
  Description of Artificial Sequence: Synthetic oligonucleotide
gcgcgcttctgctatctccc

SEQ ID NO: 1109 - DNA, 20 bp, Artificial Sequence
  Description of Artificial Sequence: Synthetic oligonucleotide
gcgttccctctgttcgtccc

SEQ ID NO: 1110 - DNA, 20 bp, Artificial Sequence
  Description of Artificial Sequence: Synthetic oligonucleotide
gcgtttcctatgttcgtccc

SEQ ID NO: 1111 - DNA, 20 bp, Artificial Sequence
  Description of Artificial Sequence: Synthetic oligonucleotide
gcgtttctctgctgtctccc

SEQ ID NO: 1112 - DNA, 20 bp, Artificial Sequence
  Description of Artificial Sequence: Synthetic oligonucleotide
gctcactcgtctgacctccc

SEQ ID NO: 1113 - DNA, 20 bp, Artificial Sequence
  Description of Artificial Sequence: Synthetic oligonucleotide
gcttcgatctgtggcctccc

SEQ ID NO: 1114 - DNA, 20 bp, Artificial Sequence
  Description of Artificial Sequence: Synthetic oligonucleotide
gcttctcgttctgtactccc

SEQ ID NO: 1115 - DNA, 20 bp, Artificial Sequence
  Description of Artificial Sequence: Synthetic oligonucleotide
gcttgaatcgtctacctccc

SEQ ID NO: 1116 - DNA, 20 bp, Artificial Sequence
  Description of Artificial Sequence: Synthetic oligonucleotide
gcttgtcctctgttcgtccc

SEQ ID NO: 1117 - DNA, 20 bp, Artificial Sequence
  Description of Artificial Sequence: Synthetic oligonucleotide
gctttcgtctatttgtcccc

SEQ ID NO: 1118 - DNA, 20 bp, Artificial Sequence
  Description of Artificial Sequence: Synthetic oligonucleotide
gcttttcgtctccagtcccc

SEQ ID NO: 1119 - DNA, 21 bp, Artificial Sequence
  Description of Artificial Sequence: Synthetic oligonucleotide
gtactgtcgtctgttcgtccc

SEQ ID NO: 1120 - DNA, 20 bp, Artificial Sequence
  Description of Artificial Sequence: Synthetic oligonucleotide
gtagtcttctgtttcctccc

SEQ ID NO: 1121 - DNA, 21 bp, Artificial Sequence
  Description of Artificial Sequence: Synthetic oligonucleotide
gtccggtcgtctgttcgtccc

SEQ ID NO: 1122 - DNA, 21 bp, Artificial Sequence
  Description of Artificial Sequence: Synthetic oligonucleotide
gtcctgtcgtctgttcgtcgc

SEQ ID NO: 1123 - DNA, 20 bp, Artificial Sequence
  Description of Artificial Sequence: Synthetic oligonucleotide
gtcttcgtctgctgcttccc

SEQ ID NO: 1124 - DNA, 20 bp, Artificial Sequence
  Description of Artificial Sequence: Synthetic oligonucleotide
gtgaagatcgtctacctccc

SEQ ID NO: 1125 - DNA, 20 bp, Artificial Sequence
  Description of Artificial Sequence: Synthetic oligonucleotide
gtgactcctctgttccgccc

SEQ ID NO: 1126 - DNA, 20 bp, Artificial Sequence
  Description of Artificial Sequence: Synthetic oligonucleotide
gtgatgttcgtcgctctccc

SEQ ID NO: 1127 - DNA, 20 bp, Artificial Sequence
  Description of Artificial Sequence: Synthetic oligonucleotide
gtgattcgtccgtacctccc

SEQ ID NO: 1128 - DNA, 20 bp, Artificial Sequence
  Description of Artificial Sequence: Synthetic oligonucleotide
gtgattcgtctctccgtccc

SEQ ID NO: 1129 - DNA, 20 bp, Artificial Sequence
  Description of Artificial Sequence: Synthetic oligonucleotide
gtgcttcgtctgttcgtccc

SEQ ID NO: 1130 - DNA, 20 bp, Artificial Sequence
  Description of Artificial Sequence: Synthetic oligonucleotide
gtggagctgaaccctctggc

SEQ ID NO: 1131 - DNA, 20 bp, Artificial Sequence
  Description of Artificial Sequence: Synthetic oligonucleotide
gttgctgtcgtcgctgtccc

SEQ ID NO: 1132 - DNA, 20 bp, Artificial Sequence
  Description of Artificial Sequence: Synthetic oligonucleotide
tactgtcgtatgttcgtacc

SEQ ID NO: 1133 - DNA, 20 bp, Artificial Sequence
  Description of Artificial Sequence: Synthetic oligonucleotide
tcatgtcgtctgttcgtaac

SEQ ID NO: 1134 - DNA, 20 bp, Artificial Sequence
  Description of Artificial Sequence: Synthetic oligonucleotide
tccagtcgtctattcgtccc

SEQ ID NO: 1135 - DNA, 20 bp, Artificial Sequence
  Description of Artificial Sequence: Synthetic oligonucleotide
tccagtcgtctgttcgttcc

SEQ ID NO: 1136 - DNA, 20 bp, Artificial Sequence
  Description of Artificial Sequence: Synthetic oligonucleotide
tcccgccgtctgttcgtccc

SEQ ID NO: 1137 - DNA, 20 bp, Artificial Sequence
  Description of Artificial Sequence: Synthetic oligonucleotide
tcccgtcatctgttcgtccc

SEQ ID NO: 1138 - DNA, 20 bp, Artificial Sequence
  Description of Artificial Sequence: Synthetic oligonucleotide
tcccgtcgtctgttcatccc

SEQ ID NO: 1139 - DNA, 20 bp, Artificial Sequence
  Description of Artificial Sequence: Synthetic oligonucleotide
tcccgtcgtctgttcgtttc

SEQ ID NO: 1140 - DNA, 20 bp, Artificial Sequence
  Description of Artificial Sequence: Synthetic oligonucleotide
tcctatcgtctgttcatccc

SEQ ID NO: 1141 - DNA, 20 bp, Artificial Sequence
  Description of Artificial Sequence: Synthetic oligonucleotide
tcctctcgtctgctcgtccc

SEQ ID NO: 1142 - DNA, 20 bp, Artificial Sequence
  Description of Artificial Sequence: Synthetic oligonucleotide
tcctgacgtctgttcgaccc

SEQ ID NO: 1143 - DNA, 20 bp, Artificial Sequence
  Description of Artificial Sequence: Synthetic oligonucleotide
tcctgccgtctgctcgtccc

SEQ ID NO: 1144 - DNA, 19 bp, Artificial Sequence
  Description of Artificial Sequence: Synthetic oligonucleotide
tcctgccgtctgttcgtcc

SEQ ID NO: 1145 - DNA, 20 bp, Artificial Sequence
  Description of Artificial Sequence: Synthetic oligonucleotide
tcctgccttgtcgttgtccc

SEQ ID NO: 1146 - DNA, 20 bp, Artificial Sequence
  Description of Artificial Sequence: Synthetic oligonucleotide
tcctggctagtcgttgtccc

SEQ ID NO: 1147 - DNA, 20 bp, Artificial Sequence
  Description of Artificial Sequence: Synthetic oligonucleotide
tcctggcttgtcgtggtccc

SEQ ID NO: 1148 - DNA, 20 bp, Artificial Sequence
  Description of Artificial Sequence: Synthetic oligonucleotide
tcctggcttgtcgttgaccc

SEQ ID NO: 1149 - DNA, 20 bp, Artificial Sequence
  Description of Artificial Sequence: Synthetic oligonucleotide
tcctgtagtatgttcgtcac

SEQ ID NO: 1150 - DNA, 20 bp, Artificial Sequence
  Description of Artificial Sequence: Synthetic oligonucleotide
tcctgtagtctgttcatccc

SEQ ID NO: 1151 - DNA, 20 bp, Artificial Sequence
  Description of Artificial Sequence: Synthetic oligonucleotide
tcctgtagtctgtttgtccc

SEQ ID NO: 1152 - DNA, 20 bp, Artificial Sequence
  Description of Artificial Sequence: Synthetic oligonucleotide
tcctgtcatctgttcgcccc

SEQ ID NO: 1153 - DNA, 20 bp, Artificial Sequence
  Description of Artificial Sequence: Synthetic oligonucleotide
tcctgtcatctgttcgttcc

SEQ ID NO: 1154 - DNA, 20 bp, Artificial Sequence
  Description of Artificial Sequence: Synthetic oligonucleotide
tcctgtcgtatgttcgtcaa

SEQ ID NO: 1155 - DNA, 20 bp, Artificial Sequence
  Description of Artificial Sequence: Synthetic oligonucleotide
tcctgtcgtcagttcgtcca

SEQ ID NO: 1156 - DNA, 20 bp, Artificial Sequence
  Description of Artificial Sequence: Synthetic oligonucleotide
tcctgtcgtccgctcgtccc

SEQ ID NO: 1157 - DNA, 19 bp, Artificial Sequence
  Description of Artificial Sequence: Synthetic oligonucleotide
tcctgtcgtccttcgtccc

SEQ ID NO: 1158 - DNA, 20 bp, Artificial Sequence
  Description of Artificial Sequence: Synthetic oligonucleotide
tcctgtcgtcctttcgtccc

SEQ ID NO: 1159 - DNA, 20 bp, Artificial Sequence
  Description of Artificial Sequence: Synthetic oligonucleotide
tcctgtcgtctattcctccc

SEQ ID NO: 1160 - DNA, 20 bp, Artificial Sequence
  Description of Artificial Sequence: Synthetic oligonucleotide
tcctgtcgtctctttgtccc

SEQ ID NO: 1161 - DNA, 20 bp, Artificial Sequence
  Description of Artificial Sequence: Synthetic oligonucleotide
tcctgtcgtctgatcgtcca

SEQ ID NO: 1162 - DNA, 19 bp, Artificial Sequence
  Description of Artificial Sequence: Synthetic oligonucleotide
tcctgtcgtctgtcccccc

SEQ ID NO: 1163 - DNA, 19 bp, Artificial Sequence
  Description of Artificial Sequence: Synthetic oligonucleotide
tcctgtcgtctgtcgcccc

SEQ ID NO: 1164 - DNA, 19 bp, Artificial Sequence
  Description of Artificial Sequence: Synthetic oligonucleotide
tcctgtcgtctgtcgtttc

SEQ ID NO: 1165 - DNA, 20 bp, Artificial Sequence
  Description of Artificial Sequence: Synthetic oligonucleotide
tcctgtcgtctgttagtaac

SEQ ID NO: 1166 - DNA, 20 bp, Artificial Sequence
  Description of Artificial Sequence: Synthetic oligonucleotide
tcctgtcgtctgttagtcct

SEQ ID NO: 1167 - DNA, 20 bp, Artificial Sequence
  Description of Artificial Sequence: Synthetic oligonucleotide
tcctgtcgtctgttcatacc

SEQ ID NO: 1168 - DNA, 20 bp, Artificial Sequence
  Description of Artificial Sequence: Synthetic oligonucleotide
tcctgtcgtctgttcgcacc

SEQ ID NO: 1169 - DNA, 21 bp, Artificial Sequence
  Description of Artificial Sequence: Synthetic oligonucleotide
tcctgtcgtctgttgtccccc

SEQ ID NO: 1170 - DNA, 21 bp, Artificial Sequence
  Description of Artificial Sequence: Synthetic oligonucleotide
tcctgtcgtctgttttgtccc

SEQ ID NO: 1171 - DNA, 20 bp, Artificial Sequence
  Description of Artificial Sequence: Synthetic oligonucleotide
tcctgtcgtttgttcgtcct

SEQ ID NO: 1172 - DNA, 20 bp, Artificial Sequence
  Description of Artificial Sequence: Synthetic oligonucleotide
tcctgtcgtttgttcgtctc

SEQ ID NO: 1173 - DNA, 21 bp, Artificial Sequence
  Description of Artificial Sequence: Synthetic oligonucleotide
tcctgttcgtctgttcgtccc

SEQ ID NO: 1174 - DNA, 20 bp, Artificial Sequence
  Description of Artificial Sequence: Synthetic oligonucleotide
tcctgttgtctgttcgtctc

SEQ ID NO: 1175 - DNA, 20 bp, Artificial Sequence
  Description of Artificial Sequence: Synthetic oligonucleotide
tcctgttgtctgttcgttcc

SEQ ID NO: 1176 - DNA, 20 bp, Artificial Sequence
  Description of Artificial Sequence: Synthetic oligonucleotide
tcctttcgtctgttcttccc

SEQ ID NO: 1177 - DNA, 20 bp, Artificial Sequence
  Description of Artificial Sequence: Synthetic oligonucleotide
tcctttcgtcttttcgtccc

SEQ ID NO: 1178 - DNA, 20 bp, Artificial Sequence
  Description of Artificial Sequence: Synthetic oligonucleotide
tcgacgtctgctgccttccc

SEQ ID NO: 1179 - DNA, 20 bp, Artificial Sequence
  Description of Artificial Sequence: Synthetic oligonucleotide
tcgagttcgttctacctccc

SEQ ID NO: 1180 - DNA, 21 bp, Artificial Sequence
  Description of Artificial Sequence: Synthetic oligonucleotide
tcgctgtcgtctgttcgtccc

SEQ ID NO: 1181 - DNA, 20 bp, Artificial Sequence
  Description of Artificial Sequence: Synthetic oligonucleotide
tcggagtcttctgttgccgc

SEQ ID NO: 1182 - DNA, 20 bp, Artificial Sequence
  Description of Artificial Sequence: Synthetic oligonucleotide
tctcagtagtgggcctgcgg

SEQ ID NO: 1183 - DNA, 20 bp, Artificial Sequence
  Description of Artificial Sequence: Synthetic oligonucleotide
tctctgggtgttctccgccc

SEQ ID NO: 1184 - DNA, 19 bp, Artificial Sequence
  Description of Artificial Sequence: Synthetic oligonucleotide
tctgtgtgggatttggccc

SEQ ID NO: 1185 - DNA, 20 bp, Artificial Sequence
  Description of Artificial Sequence: Synthetic oligonucleotide
tcttctcgtctgttcgtccc

SEQ ID NO: 1186 - DNA, 20 bp, Artificial Sequence
  Description of Artificial Sequence: Synthetic oligonucleotide
tcttgtcgtcagttcgtccc

SEQ ID NO: 1187 - DNA, 17 bp, Artificial Sequence
  Description of Artificial Sequence: Synthetic oligonucleotide
tcttgtcgtctgttccc

SEQ ID NO: 1188 - DNA, 20 bp, Artificial Sequence
  Description of Artificial Sequence: Synthetic oligonucleotide
tcttgttcgtctgccctccc

SEQ ID NO: 1189 - DNA, 20 bp, Artificial Sequence
  Description of Artificial Sequence: Synthetic oligonucleotide
tgagtcgttcccttcgcccc

SEQ ID NO: 1190 - DNA, 20 bp, Artificial Sequence
  Description of Artificial Sequence: Synthetic oligonucleotide
tgagttctctgtggcctccc

SEQ ID NO: 1191 - DNA, 20 bp, Artificial Sequence
  Description of Artificial Sequence: Synthetic oligonucleotide
tgctctcgtctgttcttccc

SEQ ID NO: 1192 - DNA, 20 bp, Artificial Sequence
  Description of Artificial Sequence: Synthetic oligonucleotide
tgctgtcgtctgtttgtccc

SEQ ID NO: 1193 - DNA, 20 bp, Artificial Sequence
  Description of Artificial Sequence: Synthetic oligonucleotide
tgctgttgtctgttcgtccc

SEQ ID NO: 1194 - DNA, 20 bp, Artificial Sequence
  Description of Artificial Sequence: Synthetic oligonucleotide
tgctttcgtctgctcctccc

SEQ ID NO: 1195 - DNA, 20 bp, Artificial Sequence
  Description of Artificial Sequence: Synthetic oligonucleotide
tgtgtcgtctgtctcgtccc

SEQ ID NO: 1196 - DNA, 20 bp, Artificial Sequence
  Description of Artificial Sequence: Synthetic oligonucleotide
ttctgtcgtctgttcgtttc

SEQ ID NO: 1197 - DNA, 21 bp, Artificial Sequence
  Description of Artificial Sequence: Synthetic oligonucleotide
tttgggggttttcccgtgccc

SEQ ID NO: 1198 - DNA, 20 bp, Artificial Sequence
  Description of Artificial Sequence: Synthetic oligonucleotide
ccttcgtctggtaccctccc

SEQ ID NO: 1199 - DNA, 20 bp, Artificial Sequence
  Description of Artificial Sequence: Synthetic oligonucleotide
tcggtctggtttttgcccgc

SEQ ID NO: 1200 - DNA, 19 bp, Artificial Sequence
  Description of Artificial Sequence: Synthetic oligonucleotide
tctctgtgggatgtggccc

SEQ ID NO: 1201 - DNA, 18 bp, Artificial Sequence
  Description of Artificial Sequence: Synthetic oligonucleotide
tctgtgtgggatgtggcc

SEQ ID NO: 1202 - DNA, 21 bp, Artificial Sequence
  Description of Artificial Sequence: Synthetic oligonucleotide
tttggggtttctcccgtgccc

SEQ ID NO: 1203 - DNA, 20 bp, Artificial Sequence
  Description of Artificial Sequence: Synthetic oligonucleotide
tttggggttttccagtgccc

SEQ ID NO: 1204 - DNA, 19 bp, Artificial Sequence
  Description of Artificial Sequence: Synthetic oligonucleotide
tttggggttttcccggccc

SEQ ID NO: 1205 - DNA, 20 bp, Artificial Sequence
  Description of Artificial Sequence: Synthetic oligonucleotide
tttggggttttcccgggccc

SEQ ID NO: 1206 - DNA, 21 bp, Artificial Sequence
  Description of Artificial Sequence: Synthetic oligonucleotide
tttggggtttttcccttgccc

SEQ ID NO: 1207 - DNA, 21 bp, Artificial Sequence
  Description of Artificial Sequence: Synthetic oligonucleotide
tttggggttttttccgtgccc

SEQ ID NO: 1208 - DNA, 19 bp, Artificial Sequence
  Description of Artificial Sequence: Synthetic oligonucleotide
tttgtgtgggatgtggccc

SEQ ID NO: 1209 - DNA, 22 bp, Artificial Sequence
  Description of Artificial Sequence: Synthetic oligonucleotide
aattatgtgttttttgtgaccg

SEQ ID NO: 1210 - DNA, 20 bp, Artificial Sequence
  Description of Artificial Sequence: Synthetic oligonucleotide
ctgtctacctcctactgccg

SEQ ID NO: 1211 - DNA, 20 bp, Artificial Sequence
  Description of Artificial Sequence: Synthetic oligonucleotide
tctgacgagtctcccatcgc

SEQ ID NO: 1212 - DNA, 20 bp, Artificial Sequence
  Description of Artificial Sequence: Synthetic oligonucleotide
accagtcgtctgttcgtccc

SEQ ID NO: 1213 - DNA, 20 bp, Artificial Sequence
  Description of Artificial Sequence: Synthetic oligonucleotide
accagtcgtttgtacctccc

SEQ ID NO: 1214 - DNA, 20 bp, Artificial Sequence
  Description of Artificial Sequence: Synthetic oligonucleotide
acctgtcgtatgttcgtacc

SEQ ID NO: 1215 - DNA, 20 bp, Artificial Sequence
  Description of Artificial Sequence: Synthetic oligonucleotide
acctgtcgtatgttcgtccc

SEQ ID NO: 1216 - DNA, 20 bp, Artificial Sequence
  Description of Artificial Sequence: Synthetic oligonucleotide
cagtcgtctattttcgtccc

SEQ ID NO: 1217 - DNA, 20 bp, Artificial Sequence
  Description of Artificial Sequence: Synthetic oligonucleotide
ccactcgtctgacacctccc

SEQ ID NO: 1218 - DNA, 20 bp, Artificial Sequence
  Description of Artificial Sequence: Synthetic oligonucleotide
cccgttgtctgtttccgccc

SEQ ID NO: 1219 - DNA, 20 bp, Artificial Sequence
  Description of Artificial Sequence: Synthetic oligonucleotide
ccctgtcgtcagttcgtccc

SEQ ID NO: 1220 - DNA, 19 bp, Artificial Sequence
  Description of Artificial Sequence: Synthetic oligonucleotide
ccctgtcgtctttcgtccc

SEQ ID NO: 1221 - DNA, 20 bp, Artificial Sequence
  Description of Artificial Sequence: Synthetic oligonucleotide
ccctttcgtctgttcgtccc

SEQ ID NO: 1222 - DNA, 20 bp, Artificial Sequence
  Description of Artificial Sequence: Synthetic oligonucleotide
ccgagtctctgcattctccc

SEQ ID NO: 1223 - DNA, 20 bp, Artificial Sequence
  Description of Artificial Sequence: Synthetic oligonucleotide
ccgattcgtctagccctccc

SEQ ID NO: 1224 - DNA, 20 bp, Artificial Sequence
  Description of Artificial Sequence: Synthetic oligonucleotide
ccgtactcgtctgacctccc

SEQ ID NO: 1225 - DNA, 18 bp, Artificial Sequence
  Description of Artificial Sequence: Synthetic oligonucleotide
cctgtcgtctgttcgtcc

SEQ ID NO: 1226 - DNA, 19 bp, Artificial Sequence
  Description of Artificial Sequence: Synthetic oligonucleotide
cctgtcgtctgtttgtccc

SEQ ID NO: 1227 - DNA, 20 bp, Artificial Sequence
  Description of Artificial Sequence: Synthetic oligonucleotide
cctgttgttctgatactccc

SEQ ID NO: 1228 - DNA, 20 bp, Artificial Sequence
  Description of Artificial Sequence: Synthetic oligonucleotide
ccttgtcgtctgattgccgc

SEQ ID NO: 1229 - DNA, 20 bp, Artificial Sequence
  Description of Artificial Sequence: Synthetic oligonucleotide
cgaatcctctgcaccttccc

SEQ ID NO: 1230 - DNA, 20 bp, Artificial Sequence
  Description of Artificial Sequence: Synthetic oligonucleotide
cgacgttctgttttgctccc

SEQ ID NO: 1231 - DNA, 20 bp, Artificial Sequence
  Description of Artificial Sequence: Synthetic oligonucleotide
cgactcgctctgaaactccc

SEQ ID NO: 1232 - DNA, 20 bp, Artificial Sequence
  Description of Artificial Sequence: Synthetic oligonucleotide
cgagcctctgatttcgtccc

SEQ ID NO: 1233 - DNA, 20 bp, Artificial Sequence
  Description of Artificial Sequence: Synthetic oligonucleotide
cgagcctctgtctctctccc

SEQ ID NO: 1234 - DNA, 20 bp, Artificial Sequence
  Description of Artificial Sequence: Synthetic oligonucleotide
cgagcgtcatttccgtcccc

SEQ ID NO: 1235 - DNA, 20 bp, Artificial Sequence
  Description of Artificial Sequence: Synthetic oligonucleotide
cgagcttctgaagtccaccc

SEQ ID NO: 1236 - DNA, 20 bp, Artificial Sequence
  Description of Artificial Sequence: Synthetic oligonucleotide
cgagtttgttctttcgtccc

SEQ ID NO: 1237 - DNA, 20 bp, Artificial Sequence
  Description of Artificial Sequence: Synthetic oligonucleotide
cgatctcgatctgttccccc

SEQ ID NO: 1238 - DNA, 20 bp, Artificial Sequence
  Description of Artificial Sequence: Synthetic oligonucleotide
cgatctcgtctgtccctccc

SEQ ID NO: 1239 - DNA, 20 bp, Artificial Sequence
  Description of Artificial Sequence: Synthetic oligonucleotide
cgattcctctgttccctccc

SEQ ID NO: 1240 - DNA, 20 bp, Artificial Sequence
  Description of Artificial Sequence: Synthetic oligonucleotide
cgattctctgtacccctccc

SEQ ID NO: 1241 - DNA, 20 bp, Artificial Sequence
  Description of Artificial Sequence: Synthetic oligonucleotide
cgcttccgtctgttactccc

SEQ ID NO: 1242 - DNA, 20 bp, Artificial Sequence
  Description of Artificial Sequence: Synthetic oligonucleotide
cgcttcgtctgtcagctccc

SEQ ID NO: 1243 - DNA, 20 bp, Artificial Sequence
  Description of Artificial Sequence: Synthetic oligonucleotide
cggcgtctgtttgttctccc

SEQ ID NO: 1244 - DNA, 20 bp, Artificial Sequence
  Description of Artificial Sequence: Synthetic oligonucleotide
cggtcgtctccaatcgtccc

SEQ ID NO: 1245 - DNA, 20 bp, Artificial Sequence
  Description of Artificial Sequence: Synthetic oligonucleotide
cgtatcgttctggccctccc

SEQ ID NO: 1246 - DNA, 20 bp, Artificial Sequence
  Description of Artificial Sequence: Synthetic oligonucleotide
cgtgtcctctgcattctccc

SEQ ID NO: 1247 - DNA, 19 bp, Artificial Sequence
  Description of Artificial Sequence: Synthetic oligonucleotide
cgttctcgtctgacgtccc

SEQ ID NO: 1248 - DNA, 20 bp, Artificial Sequence
  Description of Artificial Sequence: Synthetic oligonucleotide
cgttctcgtctgtcactccc

SEQ ID NO: 1249 - DNA, 20 bp, Artificial Sequence
  Description of Artificial Sequence: Synthetic oligonucleotide
cgtttcatctggttcctccc

SEQ ID NO: 1250 - DNA, 20 bp, Artificial Sequence
  Description of Artificial Sequence: Synthetic oligonucleotide
cgtttcctctggtccgtccc

SEQ ID NO: 1251 - DNA, 19 bp, Artificial Sequence
  Description of Artificial Sequence: Synthetic oligonucleotide
cgtttcctctggttcgttc

SEQ ID NO: 1252 - DNA, 20 bp, Artificial Sequence
  Description of Artificial Sequence: Synthetic oligonucleotide
cgtttcgtttgcctcttccc

SEQ ID NO: 1253 - DNA, 20 bp, Artificial Sequence
  Description of Artificial Sequence: Synthetic oligonucleotide
cgtttctcctggttcgtccc

SEQ ID NO: 1254 - DNA, 21 bp, Artificial Sequence
  Description of Artificial Sequence: Synthetic oligonucleotide
cgttttcctctggttcgtccc

SEQ ID NO: 1255 - DNA, 20 bp, Artificial Sequence
  Description of Artificial Sequence: Synthetic oligonucleotide
cgttttgtctgatgcctccc

SEQ ID NO: 1256 - DNA, 20 bp, Artificial Sequence
  Description of Artificial Sequence: Synthetic oligonucleotide
ctcttcgtctgcttgctccc

SEQ ID NO: 1257 - DNA, 20 bp, Artificial Sequence
  Description of Artificial Sequence: Synthetic oligonucleotide
ctgactcgtctgtccctccc

SEQ ID NO: 1258 - DNA, 20 bp, Artificial Sequence
  Description of Artificial Sequence: Synthetic oligonucleotide
ctgatcgtctgttgcctccc

SEQ ID NO: 1259 - DNA, 20 bp, Artificial Sequence
  Description of Artificial Sequence: Synthetic oligonucleotide
ctttcgtctggactcgtccc

SEQ ID NO: 1260 - DNA, 21 bp, Artificial Sequence
  Description of Artificial Sequence: Synthetic oligonucleotide
gacctgtcgtctgttcgtccc

SEQ ID NO: 1261 - DNA, 19 bp, Artificial Sequence
  Description of Artificial Sequence: Synthetic oligonucleotide
gactgtatggggttctgtg

SEQ ID NO: 1262 - DNA, 20 bp, Artificial Sequence
  Description of Artificial Sequence: Synthetic oligonucleotide
gcactcgtctgaatcctccc

SEQ ID NO: 1263 - DNA, 20 bp, Artificial Sequence
  Description of Artificial Sequence: Synthetic oligonucleotide
gcacttcgtcttaccctccc

SEQ ID NO: 1264 - DNA, 20 bp, Artificial Sequence
  Description of Artificial Sequence: Synthetic oligonucleotide
gccagcgtctgtttcctccc

SEQ ID NO: 1265 - DNA, 20 bp, Artificial Sequence
  Description of Artificial Sequence: Synthetic oligonucleotide
gccagttcttctgttgccgc

SEQ ID NO: 1266 - DNA, 20 bp, Artificial Sequence
  Description of Artificial Sequence: Synthetic oligonucleotide
gcccattcgtctaacctccc

SEQ ID NO: 1267 - DNA, 20 bp, Artificial Sequence
  Description of Artificial Sequence: Synthetic oligonucleotide
gcccttcgatctgttgtccc

SEQ ID NO: 1268 - DNA, 20 bp, Artificial Sequence
  Description of Artificial Sequence: Synthetic oligonucleotide
gcctcgtctgttttactccc

SEQ ID NO: 1269 - DNA, 20 bp, Artificial Sequence
  Description of Artificial Sequence: Synthetic oligonucleotide
gcctctcgtctacggtcctc

SEQ ID NO: 1270 - DNA, 20 bp, Artificial Sequence
  Description of Artificial Sequence: Synthetic oligonucleotide
gcctctcgtctgctcctccc

SEQ ID NO: 1271 - DNA, 20 bp, Artificial Sequence
  Description of Artificial Sequence: Synthetic oligonucleotide
gcctctcgtctgttccgccc

SEQ ID NO: 1272 - DNA, 20 bp, Artificial Sequence
  Description of Artificial Sequence: Synthetic oligonucleotide
gccttctcgtctgtcgtccc

SEQ ID NO: 1273 - DNA, 20 bp, Artificial Sequence
  Description of Artificial Sequence: Synthetic oligonucleotide
gccttctcgtctgtctgccc

SEQ ID NO: 1274 - DNA, 20 bp, Artificial Sequence
  Description of Artificial Sequence: Synthetic oligonucleotide
gccttctcgtctgttgtcca

SEQ ID NO: 1275 - DNA, 22 bp, Artificial Sequence
  Description of Artificial Sequence: Synthetic oligonucleotide
gccttctcgtctgttgtcttcc

SEQ ID NO: 1276 - DNA, 20 bp, Artificial Sequence
  Description of Artificial Sequence: Synthetic oligonucleotide
gcctttcgttatgacctccc

SEQ ID NO: 1277 - DNA, 20 bp, Artificial Sequence
  Description of Artificial Sequence: Synthetic oligonucleotide
gcctttcgttccgacctccc

SEQ ID NO: 1278 - DNA, 20 bp, Artificial Sequence
  Description of Artificial Sequence: Synthetic oligonucleotide
gcctttcgttctgccctccc

SEQ ID NO: 1279 - DNA, 20 bp, Artificial Sequence
  Description of Artificial Sequence: Synthetic oligonucleotide
gcgattcctctgttcgtccc

SEQ ID NO: 1280 - DNA, 20 bp, Artificial Sequence
  Description of Artificial Sequence: Synthetic oligonucleotide
gcgtttcccctgttcgtccc

SEQ ID NO: 1281 - DNA, 20 bp, Artificial Sequence
  Description of Artificial Sequence: Synthetic oligonucleotide
gcgtttcctccgttcgtccc

SEQ ID NO: 1282 - DNA, 20 bp, Artificial Sequence
  Description of Artificial Sequence: Synthetic oligonucleotide
gcgtttcctctgttcatccc

SEQ ID NO: 1283 - DNA, 20 bp, Artificial Sequence
  Description of Artificial Sequence: Synthetic oligonucleotide
gcgtttcctctgttcgcccc

SEQ ID NO: 1284 - DNA, 20 bp, Artificial Sequence
  Description of Artificial Sequence: Synthetic oligonucleotide
gcgtttcctctgttggtccc

SEQ ID NO: 1285 - DNA, 20 bp, Artificial Sequence
  Description of Artificial Sequence: Synthetic oligonucleotide
gctaactcgtctagcctccc

SEQ ID NO: 1286 - DNA, 20 bp, Artificial Sequence
  Description of Artificial Sequence: Synthetic oligonucleotide
gctctctcgtcttacgtccc

SEQ ID NO: 1287 - DNA, 20 bp, Artificial Sequence
  Description of Artificial Sequence: Synthetic oligonucleotide
gctttcgatctgttcgtccc

SEQ ID NO: 1288 - DNA, 20 bp, Artificial Sequence
  Description of Artificial Sequence: Synthetic oligonucleotide
gctttcttctggtgcctccc

SEQ ID NO: 1289 - DNA, 20 bp, Artificial Sequence
  Description of Artificial Sequence: Synthetic oligonucleotide
ggtgtcgttctgtccctccc

SEQ ID NO: 1290 - DNA, 20 bp, Artificial Sequence
  Description of Artificial Sequence: Synthetic oligonucleotide
gtactctcgtctgcgctccc

SEQ ID NO: 1291 - DNA, 17 bp, Artificial Sequence
  Description of Artificial Sequence: Synthetic oligonucleotide
gtcctgtcgtctgttcc

SEQ ID NO: 1292 - DNA, 20 bp, Artificial Sequence
  Description of Artificial Sequence: Synthetic oligonucleotide
gtcctgtcgtcttacgttcc

SEQ ID NO: 1293 - DNA, 20 bp, Artificial Sequence
  Description of Artificial Sequence: Synthetic oligonucleotide
gtcctgtcgtcttacgtttc

SEQ ID NO: 1294 - DNA, 20 bp, Artificial Sequence
  Description of Artificial Sequence: Synthetic oligonucleotide
gtcctgtcgtcttgtccccc

SEQ ID NO: 1295 - DNA, 20 bp, Artificial Sequence
  Description of Artificial Sequence: Synthetic oligonucleotide
gtgagcttctgctgtctccc

SEQ ID NO: 1296 - DNA, 20 bp, Artificial Sequence
  Description of Artificial Sequence: Synthetic oligonucleotide
gtgatcctctggttcgtccc

SEQ ID NO: 1297 - DNA, 20 bp, Artificial Sequence
  Description of Artificial Sequence: Synthetic oligonucleotide
gtggttctctggttcgtccc

SEQ ID NO: 1298 - DNA, 20 bp, Artificial Sequence
  Description of Artificial Sequence: Synthetic oligonucleotide
taatgtcgtctgttagtccc

SEQ ID NO: 1299 - DNA, 20 bp, Artificial Sequence
  Description of Artificial Sequence: Synthetic oligonucleotide
taatgtcgtctgttcgtacc

SEQ ID NO: 1300 - DNA, 20 bp, Artificial Sequence
  Description of Artificial Sequence: Synthetic oligonucleotide
tactgtcgtctgttagtcac

SEQ ID NO: 1301 - DNA, 20 bp, Artificial Sequence
  Description of Artificial Sequence: Synthetic oligonucleotide
tactgtcgtctgttcgtaac

SEQ ID NO: 1302 - DNA, 20 bp, Artificial Sequence
  Description of Artificial Sequence: Synthetic oligonucleotide
tcacgtcgtctgttcgtccc

SEQ ID NO: 1303 - DNA, 20 bp, Artificial Sequence
  Description of Artificial Sequence: Synthetic oligonucleotide
tcatggcttgtcgttgtccc

SEQ ID NO: 1304 - DNA, 20 bp, Artificial Sequence
  Description of Artificial Sequence: Synthetic oligonucleotide
tcatgtagtatgttcgtacc

SEQ ID NO: 1305 - DNA, 20 bp, Artificial Sequence
  Description of Artificial Sequence: Synthetic oligonucleotide
tcatgtcgtatgttagtccc

SEQ ID NO: 1306 - DNA, 20 bp, Artificial Sequence
  Description of Artificial Sequence: Synthetic oligonucleotide
tcatgtcgtctgttagtaca

SEQ ID NO: 1307 - DNA, 20 bp, Artificial Sequence
  Description of Artificial Sequence: Synthetic oligonucleotide
tcatgtcgtttgttcgtccc

SEQ ID NO: 1308 - DNA, 20 bp, Artificial Sequence
  Description of Artificial Sequence: Synthetic oligonucleotide
tccagtcgtctcttcgtccc

SEQ ID NO: 1309 - DNA, 20 bp, Artificial Sequence
  Description of Artificial Sequence: Synthetic oligonucleotide
tccagtcgtctgttcgtaca

SEQ ID NO: 1310 - DNA, 20 bp, Artificial Sequence
  Description of Artificial Sequence: Synthetic oligonucleotide
tcccctcgtctgttcgtccc

SEQ ID NO: 1311 - DNA, 19 bp, Artificial Sequence
  Description of Artificial Sequence: Synthetic oligonucleotide
tcccgtcgtctgtcgtccc

SEQ ID NO: 1312 - DNA, 20 bp, Artificial Sequence
  Description of Artificial Sequence: Synthetic oligonucleotide
tcccgtcgtctgttcgtctc

SEQ ID NO: 1313 - DNA, 20 bp, Artificial Sequence
  Description of Artificial Sequence: Synthetic oligonucleotide
tcccgtcgtctgttcttccc

SEQ ID NO: 1314 - DNA, 20 bp, Artificial Sequence
  Description of Artificial Sequence: Synthetic oligonucleotide
tcctatcgtctgttcgttcc

SEQ ID NO: 1315 - DNA, 20 bp, Artificial Sequence
  Description of Artificial Sequence: Synthetic oligonucleotide
tcctctcgtctgttcctccc

SEQ ID NO: 1316 - DNA, 20 bp, Artificial Sequence
  Description of Artificial Sequence: Synthetic oligonucleotide
tcctgccgtctgttcctccc

SEQ ID NO: 1317 - DNA, 20 bp, Artificial Sequence
  Description of Artificial Sequence: Synthetic oligonucleotide
tcctgccgtctgttcgtctc

SEQ ID NO: 1318 - DNA, 20 bp, Artificial Sequence
  Description of Artificial Sequence: Synthetic oligonucleotide
tcctgccgtctgttcgtttc

SEQ ID NO: 1319 - DNA, 20 bp, Artificial Sequence
  Description of Artificial Sequence: Synthetic oligonucleotide
tcctggcgtctggtcgtccc

SEQ ID NO: 1320 - DNA, 20 bp, Artificial Sequence
  Description of Artificial Sequence: Synthetic oligonucleotide
tcctggcttgtcggtgtccc

SEQ ID NO: 1321 - DNA, 19 bp, Artificial Sequence
  Description of Artificial Sequence: Synthetic oligonucleotide
tcctggcttgtcgttgccc

SEQ ID NO: 1322 - DNA, 21 bp, Artificial Sequence
  Description of Artificial Sequence: Synthetic oligonucleotide
tcctggcttgtcgttgtcccc

SEQ ID NO: 1323 - DNA, 20 bp, Artificial Sequence
  Description of Artificial Sequence: Synthetic oligonucleotide
tcctggcttgtcgttgtccg

SEQ ID NO: 1324 - DNA, 20 bp, Artificial Sequence
  Description of Artificial Sequence: Synthetic oligonucleotide
tcctggcttgtcgttgtcgc

SEQ ID NO: 1325 - DNA, 20 bp, Artificial Sequence
  Description of Artificial Sequence: Synthetic oligonucleotide
tcctggcttgtctttgtccc

SEQ ID NO: 1326 - DNA, 20 bp, Artificial Sequence
  Description of Artificial Sequence: Synthetic oligonucleotide
tcctggcttttcgttgtccc

SEQ ID NO: 1327 - DNA, 20 bp, Artificial Sequence
  Description of Artificial Sequence: Synthetic oligonucleotide
tcctgtagtatgttcgtacc

SEQ ID NO: 1328 - DNA, 20 bp, Artificial Sequence
  Description of Artificial Sequence: Synthetic oligonucleotide
tcctgtagtatgttcgtcca

SEQ ID NO: 1329 - DNA, 20 bp, Artificial Sequence
  Description of Artificial Sequence: Synthetic oligonucleotide
tcctgtagtctgatcgtccc

SEQ ID NO: 1330 - DNA, 20 bp, Artificial Sequence
  Description of Artificial Sequence: Synthetic oligonucleotide
tcctgtagtctgttcgaccc

SEQ ID NO: 1331 - DNA, 20 bp, Artificial Sequence
  Description of Artificial Sequence: Synthetic oligonucleotide
tcctgtagtttgttcgtccc

SEQ ID NO: 1332 - DNA, 19 bp, Artificial Sequence
  Description of Artificial Sequence: Synthetic oligonucleotide
tcctgtcatctgttcgtcc

SEQ ID NO: 1333 - DNA, 20 bp, Artificial Sequence
  Description of Artificial Sequence: Synthetic oligonucleotide
tcctgtcgcttgttcgtccc

SEQ ID NO: 1334 - DNA, 20 bp, Artificial Sequence
  Description of Artificial Sequence: Synthetic oligonucleotide
tcctgtcgtatgttcgaccc

SEQ ID NO: 1335 - DNA, 20 bp, Artificial Sequence
  Description of Artificial Sequence: Synthetic oligonucleotide
tcctgtcgtccgtctgtccc

SEQ ID NO: 1336 - DNA, 20 bp, Artificial Sequence
  Description of Artificial Sequence: Synthetic oligonucleotide
tcctgtcgtccgttcctccc

SEQ ID NO: 1337 - DNA, 20 bp, Artificial Sequence
  Description of Artificial Sequence: Synthetic oligonucleotide
tcctgtcgtccgttcgtacc

SEQ ID NO: 1338 - DNA, 19 bp, Artificial Sequence
  Description of Artificial Sequence: Synthetic oligonucleotide
tcctgtcgtctattcgtcc

SEQ ID NO: 1339 - DNA, 20 bp, Artificial Sequence
  Description of Artificial Sequence: Synthetic oligonucleotide
tcctgtcgtctcttcgcccc

SEQ ID NO: 1340 - DNA, 20 bp, Artificial Sequence
  Description of Artificial Sequence: Synthetic oligonucleotide
tcctgtcgtctcttcgtttc

SEQ ID NO: 1341 - DNA, 19 bp, Artificial Sequence
  Description of Artificial Sequence: Synthetic oligonucleotide
tcctgtcgtctgcactccc

SEQ ID NO: 1342 - DNA, 17 bp, Artificial Sequence
  Description of Artificial Sequence: Synthetic oligonucleotide
tcctgtcgtctgctccc

SEQ ID NO: 1343 - DNA, 20 bp, Artificial Sequence
  Description of Artificial Sequence: Synthetic oligonucleotide
tcctgtcgtctgtaagtccc

SEQ ID NO: 1344 - DNA, 20 bp, Artificial Sequence
  Description of Artificial Sequence: Synthetic oligonucleotide
tcctgtcgtctgtacgtcac

SEQ ID NO: 1345 - DNA, 19 bp, Artificial Sequence
  Description of Artificial Sequence: Synthetic oligonucleotide
tcctgtcgtctgtccgtcc

SEQ ID NO: 1346 - DNA, 18 bp, Artificial Sequence
  Description of Artificial Sequence: Synthetic oligonucleotide
tcctgtcgtctgtcgtcc

SEQ ID NO: 1347 - DNA, 20 bp, Artificial Sequence
  Description of Artificial Sequence: Synthetic oligonucleotide
tcctgtcgtctgttactccc

SEQ ID NO: 1348 - DNA, 20 bp, Artificial Sequence
  Description of Artificial Sequence: Synthetic oligonucleotide
tcctgtcgtctgttagtcaa

SEQ ID NO: 1349 - DNA, 20 bp, Artificial Sequence
  Description of Artificial Sequence: Synthetic oligonucleotide
tcctgtcgtctgttcatcac

SEQ ID NO: 1350 - DNA, 20 bp, Artificial Sequence
  Description of Artificial Sequence: Synthetic oligonucleotide
tcctgtcgtctgttcatttc

SEQ ID NO: 1351 - DNA, 19 bp, Artificial Sequence
  Description of Artificial Sequence: Synthetic oligonucleotide
tcctgtcgtctgttcgacc

SEQ ID NO: 1352 - DNA, 20 bp, Artificial Sequence
  Description of Artificial Sequence: Synthetic oligonucleotide
tcctgtcgtctgttcgatcc

SEQ ID NO: 1353 - DNA, 21 bp, Artificial Sequence
  Description of Artificial Sequence: Synthetic oligonucleotide
tcctgtcgtctgttcgtaccc

SEQ ID NO: 1354 - DNA, 21 bp, Artificial Sequence
  Description of Artificial Sequence: Synthetic oligonucleotide
tcctgtcgtctgttcgtccct

SEQ ID NO: 1355 - DNA, 21 bp, Artificial Sequence
  Description of Artificial Sequence: Synthetic oligonucleotide
tcctgtcgtctgttcgtcctc

SEQ ID NO: 1356 - DNA, 20 bp, Artificial Sequence
  Description of Artificial Sequence: Synthetic oligonucleotide
tcctgtcgtctgttcgttcg

SEQ ID NO: 1357 - DNA, 20 bp, Artificial Sequence
  Description of Artificial Sequence: Synthetic oligonucleotide
tcctgtcgtctgttcgttct

SEQ ID NO: 1358 - DNA, 20 bp, Artificial Sequence
  Description of Artificial Sequence: Synthetic oligonucleotide
tcctgtcgtctgttctgttc

SEQ ID NO: 1359 - DNA, 20 bp, Artificial Sequence
  Description of Artificial Sequence: Synthetic oligonucleotide
tcctgtcgtctgttcttacc

SEQ ID NO: 1360 - DNA, 20 bp, Artificial Sequence
  Description of Artificial Sequence: Synthetic oligonucleotide
tcctgtcgtctgttcttcac

SEQ ID NO: 1361 - DNA, 20 bp, Artificial Sequence
  Description of Artificial Sequence: Synthetic oligonucleotide
tcctgtcgtctgttcttcca

SEQ ID NO: 1362 - DNA, 20 bp, Artificial Sequence
  Description of Artificial Sequence: Synthetic oligonucleotide
tcctgtcgtctgttgctccc

SEQ ID NO: 1363 - DNA, 20 bp, Artificial Sequence
  Description of Artificial Sequence: Synthetic oligonucleotide
tcctgtcgtctgtttgtttc

SEQ ID NO: 1364 - DNA, 20 bp, Artificial Sequence
  Description of Artificial Sequence: Synthetic oligonucleotide
tcctgtcgtcttttcctccc

SEQ ID NO: 1365 - DNA, 20 bp, Artificial Sequence
  Description of Artificial Sequence: Synthetic oligonucleotide
tcctgtcgtcttttcgtctc

SEQ ID NO: 1366 - DNA, 20 bp, Artificial Sequence
  Description of Artificial Sequence: Synthetic oligonucleotide
tcctgtcgtctttttgtccc

SEQ ID NO: 1367 - DNA, 20 bp, Artificial Sequence
  Description of Artificial Sequence: Synthetic oligonucleotide
tcctgtcgtttgctcgtccc

SEQ ID NO: 1368 - DNA, 20 bp, Artificial Sequence
  Description of Artificial Sequence: Synthetic oligonucleotide
tcctgtcgtttgttcgtcca

SEQ ID NO: 1369 - DNA, 20 bp, Artificial Sequence
  Description of Artificial Sequence: Synthetic oligonucleotide
tcctgtcgtttgttcgtttc

SEQ ID NO: 1370 - DNA, 20 bp, Artificial Sequence
  Description of Artificial Sequence: Synthetic oligonucleotide
tcctgtcgtttgttcttccc

SEQ ID NO: 1371 - DNA, 20 bp, Artificial Sequence
  Description of Artificial Sequence: Synthetic oligonucleotide
tcctgtcgtttgttggtccc

SEQ ID NO: 1372 - DNA, 20 bp, Artificial Sequence
  Description of Artificial Sequence: Synthetic oligonucleotide
tcctgtcgttttttcgtccc

SEQ ID NO: 1373 - DNA, 20 bp, Artificial Sequence
  Description of Artificial Sequence: Synthetic oligonucleotide
tcctgttgtctgttcgtcac

SEQ ID NO: 1374 - DNA, 20 bp, Artificial Sequence
  Description of Artificial Sequence: Synthetic oligonucleotide
tcctttcgtctgttcgtctc

SEQ ID NO: 1375 - DNA, 20 bp, Artificial Sequence
  Description of Artificial Sequence: Synthetic oligonucleotide
tcctttcttctgttcgtccc

SEQ ID NO: 1376 - DNA, 20 bp, Artificial Sequence
  Description of Artificial Sequence: Synthetic oligonucleotide
tcgacgtctgttggtccccc

SEQ ID NO: 1377 - DNA, 20 bp, Artificial Sequence
  Description of Artificial Sequence: Synthetic oligonucleotide
tcgatctggtattcccccgc

SEQ ID NO: 1378 - DNA, 20 bp, Artificial Sequence
  Description of Artificial Sequence: Synthetic oligonucleotide
tcgctgtcgtcttgcctccc

SEQ ID NO: 1379 - DNA, 20 bp, Artificial Sequence
  Description of Artificial Sequence: Synthetic oligonucleotide
tctctctgggtttgccgccc

SEQ ID NO: 1380 - DNA, 19 bp, Artificial Sequence
  Description of Artificial Sequence: Synthetic oligonucleotide
tctgtcgtctgttcgttcc

SEQ ID NO: 1381 - DNA, 19 bp, Artificial Sequence
  Description of Artificial Sequence: Synthetic oligonucleotide
tctgtgtgggatgtgcccc

SEQ ID NO: 1382 - DNA, 21 bp, Artificial Sequence
  Description of Artificial Sequence: Synthetic oligonucleotide
tctgttgcgcttgatatgccc

SEQ ID NO: 1383 - DNA, 20 bp, Artificial Sequence
  Description of Artificial Sequence: Synthetic oligonucleotide
tcttctggcttttccctggc

SEQ ID NO: 1384 - DNA, 20 bp, Artificial Sequence
  Description of Artificial Sequence: Synthetic oligonucleotide
tcttctgggttttgccgccc

SEQ ID NO: 1385 - DNA, 20 bp, Artificial Sequence
  Description of Artificial Sequence: Synthetic oligonucleotide
tcttgtcgtctactcgtccc

SEQ ID NO: 1386 - DNA, 20 bp, Artificial Sequence
  Description of Artificial Sequence: Synthetic oligonucleotide
tcttgtcttctgttcgtccc

SEQ ID NO: 1387 - DNA, 20 bp, Artificial Sequence
  Description of Artificial Sequence: Synthetic oligonucleotide
tgactcgttctgaccctccc

SEQ ID NO: 1388 - DNA, 20 bp, Artificial Sequence
  Description of Artificial Sequence: Synthetic oligonucleotide
tgagtcgtgtcgggccgcta

SEQ ID NO: 1389 - DNA, 20 bp, Artificial Sequence
  Description of Artificial Sequence: Synthetic oligonucleotide
tgagtcgttcccttcgtacc

SEQ ID NO: 1390 - DNA, 20 bp, Artificial Sequence
  Description of Artificial Sequence: Synthetic oligonucleotide
tgagtcttctgttccgtccc

SEQ ID NO: 1391 - DNA, 20 bp, Artificial Sequence
  Description of Artificial Sequence: Synthetic oligonucleotide
tgagttctctgtaccctccc

SEQ ID NO: 1392 - DNA, 20 bp, Artificial Sequence
  Description of Artificial Sequence: Synthetic oligonucleotide
tgagttgtccttgtggccgc

SEQ ID NO: 1393 - DNA, 20 bp, Artificial Sequence
  Description of Artificial Sequence: Synthetic oligonucleotide
tgcgagcttctggacctccc

SEQ ID NO: 1394 - DNA, 20 bp, Artificial Sequence
  Description of Artificial Sequence: Synthetic oligonucleotide
tgctattcgtctgtactccc

SEQ ID NO: 1395 - DNA, 20 bp, Artificial Sequence
  Description of Artificial Sequence: Synthetic oligonucleotide
tgctggcttgtcgttgtccc

SEQ ID NO: 1396 - DNA, 20 bp, Artificial Sequence
  Description of Artificial Sequence: Synthetic oligonucleotide
tgtagttgtttgtgggccgc

SEQ ID NO: 1397 - DNA, 20 bp, Artificial Sequence
  Description of Artificial Sequence: Synthetic oligonucleotide
ttccgagtctctgttgccgc

SEQ ID NO: 1398 - DNA, 21 bp, Artificial Sequence
  Description of Artificial Sequence: Synthetic oligonucleotide
ttcggggtttttcccgtgccc

SEQ ID NO: 1399 - DNA, 20 bp, Artificial Sequence
  Description of Artificial Sequence: Synthetic oligonucleotide
ttctgtcgtctgttcgttcc

SEQ ID NO: 1400 - DNA, 21 bp, Artificial Sequence
  Description of Artificial Sequence: Synthetic oligonucleotide
ttggggttttttcccgtgccc

SEQ ID NO: 1401 - DNA, 20 bp, Artificial Sequence
  Description of Artificial Sequence: Synthetic oligonucleotide
tttgaggttttcccgtgccc

SEQ ID NO: 1402 - DNA, 20 bp, Artificial Sequence
  Description of Artificial Sequence: Synthetic oligonucleotide
tttggggttttcccgtgcgg

SEQ ID NO: 1403 - DNA, 20 bp, Artificial Sequence
  Description of Artificial Sequence: Synthetic oligonucleotide
tttggggttttcctccgccc

SEQ ID NO: 1404 - DNA, 21 bp, Artificial Sequence
  Description of Artificial Sequence: Synthetic oligonucleotide
tttggggtttttcccgcgccc

SEQ ID NO: 1405 - DNA, 19 bp, Artificial Sequence
  Description of Artificial Sequence: Synthetic oligonucleotide
tttgggttttcccgtgccc

SEQ ID NO: 1406 - DNA, 20 bp, Artificial Sequence
  Description of Artificial Sequence: Synthetic oligonucleotide
acctgtcgtctgttagtccc

SEQ ID NO: 1407 - DNA, 20 bp, Artificial Sequence
  Description of Artificial Sequence: Synthetic oligonucleotide
tcgtattatccgctgcacgc

SEQ ID NO: 1408 - DNA, 20 bp, Artificial Sequence
  Description of Artificial Sequence: Synthetic oligonucleotide
tctgtacattcctgcctgtg

SEQ ID NO: 1409 - DNA, 21 bp, Artificial Sequence
  Description of Artificial Sequence: Synthetic oligonucleotide
tctgttgtgcttgatatgctc

SEQ ID NO: 1410 - DNA, 20 bp, Artificial Sequence
  Description of Artificial Sequence: Synthetic oligonucleotide
tttgcggttttcccgtgccc

SEQ ID NO: 1411 - DNA, 20 bp, Artificial Sequence
  Description of Artificial Sequence: Synthetic oligonucleotide
tttggagttttcccgtgccc

SEQ ID NO: 1412 - DNA, 20 bp, Artificial Sequence
  Description of Artificial Sequence: Synthetic oligonucleotide
tttggggtttacccgtgccc

SEQ ID NO: 1413 - DNA, 20 bp, Artificial Sequence
  Description of Artificial Sequence: Synthetic oligonucleotide
tttggggtttcttcctgccc

SEQ ID NO: 1414 - DNA, 20 bp, Artificial Sequence
  Description of Artificial Sequence: Synthetic oligonucleotide
tttggggttttcgcgtgccc

SEQ ID NO: 1415 - DNA, 21 bp, Artificial Sequence
  Description of Artificial Sequence: Synthetic oligonucleotide
tttggggtttttcccatgccc

SEQ ID NO: 1416 - DNA, 20 bp, Artificial Sequence
  Description of Artificial Sequence: Synthetic oligonucleotide
cttcacacattcccggtgtg

SEQ ID NO: 1417 - DNA, 19 bp, Artificial Sequence
  Description of Artificial Sequence: Synthetic oligonucleotide
gactgtatggggctttgtg

SEQ ID NO: 1418 - DNA, 21 bp, Artificial Sequence
  Description of Artificial Sequence: Synthetic oligonucleotide
tctgttgtgcttgatgtgccc

SEQ ID NO: 1419 - DNA, 19 bp, Artificial Sequence
  Description of Artificial Sequence: Synthetic oligonucleotide
tttggggtctcccgtgccc

SEQ ID NO: 1420 - DNA, 20 bp, Artificial Sequence
  Description of Artificial Sequence: Synthetic oligonucleotide
tttggggttttcccgtggcc

SEQ ID NO: 1421 - DNA, 20 bp, Artificial Sequence
  Description of Artificial Sequence: Synthetic oligonucleotide
acatgtcgtctgttcgtccc

SEQ ID NO: 1422 - DNA, 20 bp, Artificial Sequence
  Description of Artificial Sequence: Synthetic oligonucleotide
acctgtcgtctgttagtaca

SEQ ID NO: 1423 - DNA, 20 bp, Artificial Sequence
  Description of Artificial Sequence: Synthetic oligonucleotide
acctgtcgtctgttagtcca

SEQ ID NO: 1424 - DNA, 20 bp, Artificial Sequence
  Description of Artificial Sequence: Synthetic oligonucleotide
acgggtcctctgctactccc

SEQ ID NO: 1425 - DNA, 20 bp, Artificial Sequence
  Description of Artificial Sequence: Synthetic oligonucleotide
cagagtcgttccctcgtccc

SEQ ID NO: 1426 - DNA, 20 bp, Artificial Sequence
  Description of Artificial Sequence: Synthetic oligonucleotide
cagtcgctctgcactctccc

SEQ ID NO: 1427 - DNA, 20 bp, Artificial Sequence
  Description of Artificial Sequence: Synthetic oligonucleotide
catcgtttcgtctgtggcgc

SEQ ID NO: 1428 - DNA, 20 bp, Artificial Sequence
  Description of Artificial Sequence: Synthetic oligonucleotide
catttcctctggttcgtccc

SEQ ID NO: 1429 - DNA, 20 bp, Artificial Sequence
  Description of Artificial Sequence: Synthetic oligonucleotide
ccagtcagtctgccactccc

SEQ ID NO: 1430 - DNA, 20 bp, Artificial Sequence
  Description of Artificial Sequence: Synthetic oligonucleotide
ccagtcgtcaatcacgtccc

SEQ ID NO: 1431 - DNA, 20 bp, Artificial Sequence
  Description of Artificial Sequence: Synthetic oligonucleotide
ccagtcgtctcttgcgtccc

SEQ ID NO: 1432 - DNA, 20 bp, Artificial Sequence
  Description of Artificial Sequence: Synthetic oligonucleotide
ccagtcgttctttccctccc

SEQ ID NO: 1433 - DNA, 20 bp, Artificial Sequence
  Description of Artificial Sequence: Synthetic oligonucleotide
ccagtctgtctgagcctccc

SEQ ID NO: 1434 - DNA, 20 bp, Artificial Sequence
  Description of Artificial Sequence: Synthetic oligonucleotide
cccggtcgtctgttcgtccc

SEQ ID NO: 1435 - DNA, 20 bp, Artificial Sequence
  Description of Artificial Sequence: Synthetic oligonucleotide
cccgttgtctgatctctccc

SEQ ID NO: 1436 - DNA, 18 bp, Artificial Sequence
  Description of Artificial Sequence: Synthetic oligonucleotide
ccctgtcgtctgttcgtc

SEQ ID NO: 1437 - DNA, 20 bp, Artificial Sequence
  Description of Artificial Sequence: Synthetic oligonucleotide
ccctgtcgtctgttcgtccg

SEQ ID NO: 1438 - DNA, 17 bp, Artificial Sequence
  Description of Artificial Sequence: Synthetic oligonucleotide
ccctgtctgttcgtccc

SEQ ID NO: 1439 - DNA, 19 bp, Artificial Sequence
  Description of Artificial Sequence: Synthetic oligonucleotide
ccctgtgtctgttcgtccc

SEQ ID NO: 1440 - DNA, 20 bp, Artificial Sequence
  Description of Artificial Sequence: Synthetic oligonucleotide
ccgaagtcgtcttgcctccc

SEQ ID NO: 1441 - DNA, 20 bp, Artificial Sequence
  Description of Artificial Sequence: Synthetic oligonucleotide
ccgatcgggctgcgttggtc

SEQ ID NO: 1442 - DNA, 20 bp, Artificial Sequence
  Description of Artificial Sequence: Synthetic oligonucleotide
ccgatcgtctattccctccc

SEQ ID NO: 1443 - DNA, 20 bp, Artificial Sequence
  Description of Artificial Sequence: Synthetic oligonucleotide
ccgattcgttctgcgctccc

SEQ ID NO: 1444 - DNA, 20 bp, Artificial Sequence
  Description of Artificial Sequence: Synthetic oligonucleotide
ccgggtctctgtttactccc

SEQ ID NO: 1445 - DNA, 20 bp, Artificial Sequence
  Description of Artificial Sequence: Synthetic oligonucleotide
ccgtcgtctgtcaacctccc

SEQ ID NO: 1446 - DNA, 18 bp, Artificial Sequence
  Description of Artificial Sequence: Synthetic oligonucleotide
ccgtcgtctgttcgtccc

SEQ ID NO: 1447 - DNA, 20 bp, Artificial Sequence
  Description of Artificial Sequence: Synthetic oligonucleotide
cctcagtagtgggcctgctg

SEQ ID NO: 1448 - DNA, 20 bp, Artificial Sequence
  Description of Artificial Sequence: Synthetic oligonucleotide
cctgattcgtctgcgctccc

SEQ ID NO: 1449 - DNA, 19 bp, Artificial Sequence
  Description of Artificial Sequence: Synthetic oligonucleotide
cctgtcgcctgttcgtccc

SEQ ID NO: 1450 - DNA, 18 bp, Artificial Sequence
  Description of Artificial Sequence: Synthetic oligonucleotide
cctgtcgtctttcgtccc

SEQ ID NO: 1451 - DNA, 20 bp, Artificial Sequence
  Description of Artificial Sequence: Synthetic oligonucleotide
cctgtcgtcttttgcgtccc

SEQ ID NO: 1452 - DNA, 19 bp, Artificial Sequence
  Description of Artificial Sequence: Synthetic oligonucleotide
cctgtcgtttgttcgtccc

SEQ ID NO: 1453 - DNA, 20 bp, Artificial Sequence
  Description of Artificial Sequence: Synthetic oligonucleotide
cctgttgtctgttgtctccc

SEQ ID NO: 1454 - DNA, 20 bp, Artificial Sequence
  Description of Artificial Sequence: Synthetic oligonucleotide
ccttcgtctgttgtctcccc

SEQ ID NO: 1455 - DNA, 20 bp, Artificial Sequence
  Description of Artificial Sequence: Synthetic oligonucleotide
ccttcgttctgaaccctccc

SEQ ID NO: 1456 - DNA, 20 bp, Artificial Sequence
  Description of Artificial Sequence: Synthetic oligonucleotide
cgaattgttctgcccctccc

SEQ ID NO: 1457 - DNA, 20 bp, Artificial Sequence
  Description of Artificial Sequence: Synthetic oligonucleotide
cgacccgtctgtttcctccc

SEQ ID NO: 1458 - DNA, 20 bp, Artificial Sequence
  Description of Artificial Sequence: Synthetic oligonucleotide
cgactcctctgcaccttccc

SEQ ID NO: 1459 - DNA, 20 bp, Artificial Sequence
  Description of Artificial Sequence: Synthetic oligonucleotide
cgactcgtgtgcttccgccc

SEQ ID NO: 1460 - DNA, 20 bp, Artificial Sequence
  Description of Artificial Sequence: Synthetic oligonucleotide
cgactcgttcttttcgtccc

SEQ ID NO: 1461 - DNA, 20 bp, Artificial Sequence
  Description of Artificial Sequence: Synthetic oligonucleotide
cgactctctgtattcctccc

SEQ ID NO: 1462 - DNA, 20 bp, Artificial Sequence
  Description of Artificial Sequence: Synthetic oligonucleotide
cgactttcgtctgcactccc

SEQ ID NO: 1463 - DNA, 20 bp, Artificial Sequence
  Description of Artificial Sequence: Synthetic oligonucleotide
cgatcctctggactcgtccc

SEQ ID NO: 1464 - DNA, 20 bp, Artificial Sequence
  Description of Artificial Sequence: Synthetic oligonucleotide
cgatcgtctttgctcgtccc

SEQ ID NO: 1465 - DNA, 20 bp, Artificial Sequence
  Description of Artificial Sequence: Synthetic oligonucleotide
cgatcgttctgcacctgccc

SEQ ID NO: 1466 - DNA, 20 bp, Artificial Sequence
  Description of Artificial Sequence: Synthetic oligonucleotide
cgatcgttgtctggcctccc

SEQ ID NO: 1467 - DNA, 20 bp, Artificial Sequence
  Description of Artificial Sequence: Synthetic oligonucleotide
cgatctcctctgtacctccc

SEQ ID NO: 1468 - DNA, 20 bp, Artificial Sequence
  Description of Artificial Sequence: Synthetic oligonucleotide
cgatggtctgattcctgccc

SEQ ID NO: 1469 - DNA, 20 bp, Artificial Sequence
  Description of Artificial Sequence: Synthetic oligonucleotide
cgattcctctgatccctccc

SEQ ID NO: 1470 - DNA, 20 bp, Artificial Sequence
  Description of Artificial Sequence: Synthetic oligonucleotide
cgcatggtcgtcttactccc

SEQ ID NO: 1471 - DNA, 20 bp, Artificial Sequence
  Description of Artificial Sequence: Synthetic oligonucleotide
cgcgactcgtctctcgtccc

SEQ ID NO: 1472 - DNA, 20 bp, Artificial Sequence
  Description of Artificial Sequence: Synthetic oligonucleotide
cgctccgtctgattgctccc

SEQ ID NO: 1473 - DNA, 20 bp, Artificial Sequence
  Description of Artificial Sequence: Synthetic oligonucleotide
cgggcctctgctttcttccc

SEQ ID NO: 1474 - DNA, 20 bp, Artificial Sequence
  Description of Artificial Sequence: Synthetic oligonucleotide
cggtcgttctgacacctccc

SEQ ID NO: 1475 - DNA, 20 bp, Artificial Sequence
  Description of Artificial Sequence: Synthetic oligonucleotide
cggtcgtttgctgtccaccc

SEQ ID NO: 1476 - DNA, 20 bp, Artificial Sequence
  Description of Artificial Sequence: Synthetic oligonucleotide
cgtctcgtctaccagtcccc

SEQ ID NO: 1477 - DNA, 20 bp, Artificial Sequence
  Description of Artificial Sequence: Synthetic oligonucleotide
cgtctcgtttggtacctccc

SEQ ID NO: 1478 - DNA, 20 bp, Artificial Sequence
  Description of Artificial Sequence: Synthetic oligonucleotide
cgtctcgtttgtttcctccc

SEQ ID NO: 1479 - DNA, 20 bp, Artificial Sequence
  Description of Artificial Sequence: Synthetic oligonucleotide
cgtcttgtctgtgcctcccc

SEQ ID NO: 1480 - DNA, 20 bp, Artificial Sequence
  Description of Artificial Sequence: Synthetic oligonucleotide
cgtgctcgtctttgcctccc

SEQ ID NO: 1481 - DNA, 19 bp, Artificial Sequence
  Description of Artificial Sequence: Synthetic oligonucleotide
cgttcgtctgttgggccgc

SEQ ID NO: 1482 - DNA, 20 bp, Artificial Sequence
  Description of Artificial Sequence: Synthetic oligonucleotide
cgtttcctccggttcgtccc

SEQ ID NO: 1483 - DNA, 20 bp, Artificial Sequence
  Description of Artificial Sequence: Synthetic oligonucleotide
cgtttcctctggttcgcccc

SEQ ID NO: 1484 - DNA, 21 bp, Artificial Sequence
  Description of Artificial Sequence: Synthetic oligonucleotide
cgtttcgtttgttttcgtccc

SEQ ID NO: 1485 - DNA, 17 bp, Artificial Sequence
  Description of Artificial Sequence: Synthetic oligonucleotide
cgtttctggttcgtccc

SEQ ID NO: 1486 - DNA, 20 bp, Artificial Sequence
  Description of Artificial Sequence: Synthetic oligonucleotide
ctagtccgtctgagtgccgc

SEQ ID NO: 1487 - DNA, 20 bp, Artificial Sequence
  Description of Artificial Sequence: Synthetic oligonucleotide
ctgtcgaggctgcgttggtc

SEQ ID NO: 1488 - DNA, 20 bp, Artificial Sequence
  Description of Artificial Sequence: Synthetic oligonucleotide
cttgttgtctgtgtccgccc

SEQ ID NO: 1489 - DNA, 20 bp, Artificial Sequence
  Description of Artificial Sequence: Synthetic oligonucleotide
cttgttgttctgaacctccc

SEQ ID NO: 1490 - DNA, 20 bp, Artificial Sequence
  Description of Artificial Sequence: Synthetic oligonucleotide
gacactcgtctgaccctccc

SEQ ID NO: 1491 - DNA, 20 bp, Artificial Sequence
  Description of Artificial Sequence: Synthetic oligonucleotide
gacgattcttctgcactccc

SEQ ID NO: 1492 - DNA, 19 bp, Artificial Sequence
  Description of Artificial Sequence: Synthetic oligonucleotide
gactatatggggctctgtg

SEQ ID NO: 1493 - DNA, 20 bp, Artificial Sequence
  Description of Artificial Sequence: Synthetic oligonucleotide
gacttgtcgtttgacctccc

SEQ ID NO: 1494 - DNA, 20 bp, Artificial Sequence
  Description of Artificial Sequence: Synthetic oligonucleotide
gagatgttcgtctgcctccc

SEQ ID NO: 1495 - DNA, 20 bp, Artificial Sequence
  Description of Artificial Sequence: Synthetic oligonucleotide
gagtttcctctgttagtccc

SEQ ID NO: 1496 - DNA, 20 bp, Artificial Sequence
  Description of Artificial Sequence: Synthetic oligonucleotide
gagtttcgcctgttggccgc

SEQ ID NO: 1497 - DNA, 20 bp, Artificial Sequence
  Description of Artificial Sequence: Synthetic oligonucleotide
gagtttcgtctgtccgtccc

SEQ ID NO: 1498 - DNA, 20 bp, Artificial Sequence
  Description of Artificial Sequence: Synthetic oligonucleotide
gcagcgtctatattcgtccc

SEQ ID NO: 1499 - DNA, 20 bp, Artificial Sequence
  Description of Artificial Sequence: Synthetic oligonucleotide
gcattcgtctttagcctccc

SEQ ID NO: 1500 - DNA, 20 bp, Artificial Sequence
  Description of Artificial Sequence: Synthetic oligonucleotide
gcatttcctctgttcgtccc

SEQ ID NO: 1501 - DNA, 20 bp, Artificial Sequence
  Description of Artificial Sequence: Synthetic oligonucleotide
gccacagtcgttttcgtccc

SEQ ID NO: 1502 - DNA, 20 bp, Artificial Sequence
  Description of Artificial Sequence: Synthetic oligonucleotide
gccattcgtcttctcgtccc

SEQ ID NO: 1503 - DNA, 20 bp, Artificial Sequence
  Description of Artificial Sequence: Synthetic oligonucleotide
gccattcgtttgtgtgccgc

SEQ ID NO: 1504 - DNA, 20 bp, Artificial Sequence
  Description of Artificial Sequence: Synthetic oligonucleotide
gccattcttctgccactccc

SEQ ID NO: 1505 - DNA, 20 bp, Artificial Sequence
  Description of Artificial Sequence: Synthetic oligonucleotide
gcccgtcgttttgcgctccc

SEQ ID NO: 1506 - DNA, 19 bp, Artificial Sequence
  Description of Artificial Sequence: Synthetic oligonucleotide
gcccgtctctgtagctccc

SEQ ID NO: 1507 - DNA, 20 bp, Artificial Sequence
  Description of Artificial Sequence: Synthetic oligonucleotide
gcccgttcgtcttctgtccc

SEQ ID NO: 1508 - DNA, 20 bp, Artificial Sequence
  Description of Artificial Sequence: Synthetic oligonucleotide
gccctcgttctgctactccc

SEQ ID NO: 1509 - DNA, 20 bp, Artificial Sequence
  Description of Artificial Sequence: Synthetic oligonucleotide
gccctcgttctgcttctccc

SEQ ID NO: 1510 - DNA, 20 bp, Artificial Sequence
  Description of Artificial Sequence: Synthetic oligonucleotide
gccctctcgtctgttgtccc

SEQ ID NO: 1511 - DNA, 21 bp, Artificial Sequence
  Description of Artificial Sequence: Synthetic oligonucleotide
gccctgccgcctgttcgcccc

SEQ ID NO: 1512 - DNA, 20 bp, Artificial Sequence
  Description of Artificial Sequence: Synthetic oligonucleotide
gccctgtcgttttccctccc

SEQ ID NO: 1513 - DNA, 20 bp, Artificial Sequence
  Description of Artificial Sequence: Synthetic oligonucleotide
gcccttcgtctgttcgtccc

SEQ ID NO: 1514 - DNA, 20 bp, Artificial Sequence
  Description of Artificial Sequence: Synthetic oligonucleotide
gccctttcgtttgtactccc

SEQ ID NO: 1515 - DNA, 20 bp, Artificial Sequence
  Description of Artificial Sequence: Synthetic oligonucleotide
gcctagttgtctagcctccc

SEQ ID NO: 1516 - DNA, 20 bp, Artificial Sequence
  Description of Artificial Sequence: Synthetic oligonucleotide
gcctcctcgtctgttgtccc

SEQ ID NO: 1517 - DNA, 20 bp, Artificial Sequence
  Description of Artificial Sequence: Synthetic oligonucleotide
gcctcgtctgtcattctccc

SEQ ID NO: 1518 - DNA, 20 bp, Artificial Sequence
  Description of Artificial Sequence: Synthetic oligonucleotide
gcctcttgtctgtgcttccc

SEQ ID NO: 1519 - DNA, 19 bp, Artificial Sequence
  Description of Artificial Sequence: Synthetic oligonucleotide
gccttcgttctgacctccc

SEQ ID NO: 1520 - DNA, 20 bp, Artificial Sequence
  Description of Artificial Sequence: Synthetic oligonucleotide
gccttctcgtcttttctccc

SEQ ID NO: 1521 - DNA, 20 bp, Artificial Sequence
  Description of Artificial Sequence: Synthetic oligonucleotide
gcctttcctctgtgtgccgc

SEQ ID NO: 1522 - DNA, 20 bp, Artificial Sequence
  Description of Artificial Sequence: Synthetic oligonucleotide
gcctttcgatctgccctctc

SEQ ID NO: 1523 - DNA, 20 bp, Artificial Sequence
  Description of Artificial Sequence: Synthetic oligonucleotide
gcctttcgtcgttgtgccgc

SEQ ID NO: 1524 - DNA, 20 bp, Artificial Sequence
  Description of Artificial Sequence: Synthetic oligonucleotide
gcctttcgtctacgcgtccc

SEQ ID NO: 1525 - DNA, 20 bp, Artificial Sequence
  Description of Artificial Sequence: Synthetic oligonucleotide
gcctttcgttctgacatccc

SEQ ID NO: 1526 - DNA, 20 bp, Artificial Sequence
  Description of Artificial Sequence: Synthetic oligonucleotide
gcctttcgttctgacccccc

SEQ ID NO: 1527 - DNA, 20 bp, Artificial Sequence
  Description of Artificial Sequence: Synthetic oligonucleotide
gcgatcgatgtagccgcgtc

SEQ ID NO: 1528 - DNA, 20 bp, Artificial Sequence
  Description of Artificial Sequence: Synthetic oligonucleotide
gcgcttcttctgcgtctccc

SEQ ID NO: 1529 - DNA, 20 bp, Artificial Sequence
  Description of Artificial Sequence: Synthetic oligonucleotide
gcgcttcttctgttcgtccc

SEQ ID NO: 1530 - DNA, 20 bp, Artificial Sequence
  Description of Artificial Sequence: Synthetic oligonucleotide
gcgtcgtctaatatcgtccc

SEQ ID NO: 1531 - DNA, 20 bp, Artificial Sequence
  Description of Artificial Sequence: Synthetic oligonucleotide
gcgtcgtttgtccacctccc

SEQ ID NO: 1532 - DNA, 19 bp, Artificial Sequence
  Description of Artificial Sequence: Synthetic oligonucleotide
gcgttcctctgttcgtccc

SEQ ID NO: 1533 - DNA, 20 bp, Artificial Sequence
  Description of Artificial Sequence: Synthetic oligonucleotide
gcgtttcatctgttcgtccc

SEQ ID NO: 1534 - DNA, 20 bp, Artificial Sequence
  Description of Artificial Sequence: Synthetic oligonucleotide
gcgtttcctctgttcgaccc

SEQ ID NO: 1535 - DNA, 20 bp, Artificial Sequence
  Description of Artificial Sequence: Synthetic oligonucleotide
gctagcttctggttcgtccc

SEQ ID NO: 1536 - DNA, 20 bp, Artificial Sequence
  Description of Artificial Sequence: Synthetic oligonucleotide
gctcctgtcgtctatctccc

SEQ ID NO: 1537 - DNA, 20 bp, Artificial Sequence
  Description of Artificial Sequence: Synthetic oligonucleotide
gctcttcgtcttgccctccc

SEQ ID NO: 1538 - DNA, 20 bp, Artificial Sequence
  Description of Artificial Sequence: Synthetic oligonucleotide
gctgctcgtctttgcctccc

SEQ ID NO: 1539 - DNA, 20 bp, Artificial Sequence
  Description of Artificial Sequence: Synthetic oligonucleotide
gctgtcgtacttttcgtccc

SEQ ID NO: 1540 - DNA, 20 bp, Artificial Sequence
  Description of Artificial Sequence: Synthetic oligonucleotide
gcttgccttctgttcgtccc

SEQ ID NO: 1541 - DNA, 20 bp, Artificial Sequence
  Description of Artificial Sequence: Synthetic oligonucleotide
gcttggacgtcttgcctccc

SEQ ID NO: 1542 - DNA, 20 bp, Artificial Sequence
  Description of Artificial Sequence: Synthetic oligonucleotide
gcttgtcttctgtttgtccc

SEQ ID NO: 1543 - DNA, 20 bp, Artificial Sequence
  Description of Artificial Sequence: Synthetic oligonucleotide
gcttttcgttctgacgtccc

SEQ ID NO: 1544 - DNA, 22 bp, Artificial Sequence
  Description of Artificial Sequence: Synthetic oligonucleotide
ggtcctgtcgtctgttcgtccc

SEQ ID NO: 1545 - DNA, 20 bp, Artificial Sequence
  Description of Artificial Sequence: Synthetic oligonucleotide
gtcactcgtctgcgcctccc

SEQ ID NO: 1546 - DNA, 20 bp, Artificial Sequence
  Description of Artificial Sequence: Synthetic oligonucleotide
gtccagttgtctgccctccc

SEQ ID NO: 1547 - DNA, 21 bp, Artificial Sequence
  Description of Artificial Sequence: Synthetic oligonucleotide
gtccattctggtttcctgccc

SEQ ID NO: 1548 - DNA, 20 bp, Artificial Sequence
  Description of Artificial Sequence: Synthetic oligonucleotide
gtccgtcgtctgttcgtccc

SEQ ID NO: 1549 - DNA, 21 bp, Artificial Sequence
  Description of Artificial Sequence: Synthetic oligonucleotide
gtcctgtagtctgttcgtacc

SEQ ID NO: 1550 - DNA, 21 bp, Artificial Sequence
  Description of Artificial Sequence: Synthetic oligonucleotide
gtcctgtcgactgttcgtccc

SEQ ID NO: 1551 - DNA, 21 bp, Artificial Sequence
  Description of Artificial Sequence: Synthetic oligonucleotide
gtcctgtcggctgttcgtccc

SEQ ID NO: 1552 - DNA, 20 bp, Artificial Sequence
  Description of Artificial Sequence: Synthetic oligonucleotide
gtcctgtcgtcgatgctccc

SEQ ID NO: 1553 - DNA, 21 bp, Artificial Sequence
  Description of Artificial Sequence: Synthetic oligonucleotide
gtcctgtcgtctggttgtccc

SEQ ID NO: 1554 - DNA, 19 bp, Artificial Sequence
  Description of Artificial Sequence: Synthetic oligonucleotide
gtcctgtcgtctgttcccc

SEQ ID NO: 1555 - DNA, 20 bp, Artificial Sequence
  Description of Artificial Sequence: Synthetic oligonucleotide
gtcctgtcgtctgttccccc

SEQ ID NO: 1556 - DNA, 21 bp, Artificial Sequence
  Description of Artificial Sequence: Synthetic oligonucleotide
gtcctgtcgtctgttcggccc

SEQ ID NO: 1557 - DNA, 19 bp, Artificial Sequence
  Description of Artificial Sequence: Synthetic oligonucleotide
gtcctgtcgtcttcgtccc

SEQ ID NO: 1558 - DNA, 21 bp, Artificial Sequence
  Description of Artificial Sequence: Synthetic oligonucleotide
gtcctgtcttctgttcgtccc

SEQ ID NO: 1559 - DNA, 20 bp, Artificial Sequence
  Description of Artificial Sequence: Synthetic oligonucleotide
gtcgtcttgctcatcgtccc

SEQ ID NO: 1560 - DNA, 20 bp, Artificial Sequence
  Description of Artificial Sequence: Synthetic oligonucleotide
gtcgtgctgtgtttcctccc

SEQ ID NO: 1561 - DNA, 20 bp, Artificial Sequence
  Description of Artificial Sequence: Synthetic oligonucleotide
gtcgtgtcgtttgccctccc

SEQ ID NO: 1562 - DNA, 20 bp, Artificial Sequence
  Description of Artificial Sequence: Synthetic oligonucleotide
gtcgttaactggttcctccc

SEQ ID NO: 1563 - DNA, 20 bp, Artificial Sequence
  Description of Artificial Sequence: Synthetic oligonucleotide
gtcgttctgtctatcgtccc

SEQ ID NO: 1564 - DNA, 20 bp, Artificial Sequence
  Description of Artificial Sequence: Synthetic oligonucleotide
gtgactctctggttcgtccc

SEQ ID NO: 1565 - DNA, 20 bp, Artificial Sequence
  Description of Artificial Sequence: Synthetic oligonucleotide
gtgattcgttgctgtccccc

SEQ ID NO: 1566 - DNA, 20 bp, Artificial Sequence
  Description of Artificial Sequence: Synthetic oligonucleotide
gtgattcttctggccctccc

SEQ ID NO: 1567 - DNA, 20 bp, Artificial Sequence
  Description of Artificial Sequence: Synthetic oligonucleotide
gtgattgcgtctcacgtccc

SEQ ID NO: 1568 - DNA, 19 bp, Artificial Sequence
  Description of Artificial Sequence: Synthetic oligonucleotide
gtgctcgtctgttcgtccc

SEQ ID NO: 1569 - DNA, 20 bp, Artificial Sequence
  Description of Artificial Sequence: Synthetic oligonucleotide
gtggttcgtttgtccctccc

SEQ ID NO: 1570 - DNA, 20 bp, Artificial Sequence
  Description of Artificial Sequence: Synthetic oligonucleotide
gttgatttcgtcttgctccc

SEQ ID NO: 1571 - DNA, 21 bp, Artificial Sequence
  Description of Artificial Sequence: Synthetic oligonucleotide
gttggggtttttcccgtgccc

SEQ ID NO: 1572 - DNA, 20 bp, Artificial Sequence
  Description of Artificial Sequence: Synthetic oligonucleotide
taatgtcgtatgttcgtccc

SEQ ID NO: 1573 - DNA, 20 bp, Artificial Sequence
  Description of Artificial Sequence: Synthetic oligonucleotide
taatgtcgtctgttcgtcca

SEQ ID NO: 1574 - DNA, 20 bp, Artificial Sequence
  Description of Artificial Sequence: Synthetic oligonucleotide
tactgtagtctgttcgtcca

SEQ ID NO: 1575 - DNA, 20 bp, Artificial Sequence
  Description of Artificial Sequence: Synthetic oligonucleotide
tactgtcgtatgttagtccc

SEQ ID NO: 1576 - DNA, 20 bp, Artificial Sequence
  Description of Artificial Sequence: Synthetic oligonucleotide
tactgtcgtctgttcatccc

SEQ ID NO: 1577 - DNA, 20 bp, Artificial Sequence
  Description of Artificial Sequence: Synthetic oligonucleotide
tactgtcgtctgttcgtctc

SEQ ID NO: 1578 - DNA, 20 bp, Artificial Sequence
  Description of Artificial Sequence: Synthetic oligonucleotide
tactgtcgtctgttcgttcc

SEQ ID NO: 1579 - DNA, 20 bp, Artificial Sequence
  Description of Artificial Sequence: Synthetic oligonucleotide
tactgttgtctgttcgtccc

SEQ ID NO: 1580 - DNA, 20 bp, Artificial Sequence
  Description of Artificial Sequence: Synthetic oligonucleotide
tagtctctgggttcccgccc

SEQ ID NO: 1581 - DNA, 20 bp, Artificial Sequence
  Description of Artificial Sequence: Synthetic oligonucleotide
tattgtcgtctgttcgtccc

SEQ ID NO: 1582 - DNA, 20 bp, Artificial Sequence
  Description of Artificial Sequence: Synthetic oligonucleotide
tcatgtagtctgttcgtcac

SEQ ID NO: 1583 - DNA, 20 bp, Artificial Sequence
  Description of Artificial Sequence: Synthetic oligonucleotide
tcatgtcgtatgttcgtcac

SEQ ID NO: 1584 - DNA, 20 bp, Artificial Sequence
  Description of Artificial Sequence: Synthetic oligonucleotide
tcatgtcgtatgttcgtcca

SEQ ID NO: 1585 - DNA, 20 bp, Artificial Sequence
  Description of Artificial Sequence: Synthetic oligonucleotide
tcatgtcgtcagttcgtccc

SEQ ID NO: 1586 - DNA, 20 bp, Artificial Sequence
  Description of Artificial Sequence: Synthetic oligonucleotide
tcatgtcgtctgctcgtccc

SEQ ID NO: 1587 - DNA, 20 bp, Artificial Sequence
  Description of Artificial Sequence: Synthetic oligonucleotide
tcatgtcgtctgttcatccc

SEQ ID NO: 1588 - DNA, 20 bp, Artificial Sequence
  Description of Artificial Sequence: Synthetic oligonucleotide
tccagtcgtctgttcgtcca

SEQ ID NO: 1589 - DNA, 20 bp, Artificial Sequence
  Description of Artificial Sequence: Synthetic oligonucleotide
tcccgtccttttaccctccc

SEQ ID NO: 1590 - DNA, 20 bp, Artificial Sequence
  Description of Artificial Sequence: Synthetic oligonucleotide
tcccgtcgtctgttcgtacc

SEQ ID NO: 1591 - DNA, 20 bp, Artificial Sequence
  Description of Artificial Sequence: Synthetic oligonucleotide
tcccgtcgtctgttcgtcct

SEQ ID NO: 1592 - DNA, 20 bp, Artificial Sequence
  Description of Artificial Sequence: Synthetic oligonucleotide
tcccgtcttctgttcgtccc

SEQ ID NO: 1593 - DNA, 20 bp, Artificial Sequence
  Description of Artificial Sequence: Synthetic oligonucleotide
tccctcgtctgttccctccc

SEQ ID NO: 1594 - DNA, 20 bp, Artificial Sequence
  Description of Artificial Sequence: Synthetic oligonucleotide
tcctatcgtctgttcctccc

SEQ ID NO: 1595 - DNA, 20 bp, Artificial Sequence
  Description of Artificial Sequence: Synthetic oligonucleotide
tcctatcgtcttttcgtccc

SEQ ID NO: 1596 - DNA, 18 bp, Artificial Sequence
  Description of Artificial Sequence: Synthetic oligonucleotide
tcctcgtctgttcgtccc

SEQ ID NO: 1597 - DNA, 20 bp, Artificial Sequence
  Description of Artificial Sequence: Synthetic oligonucleotide
tcctgacgtatgttcgtccc

SEQ ID NO: 1598 - DNA, 20 bp, Artificial Sequence
  Description of Artificial Sequence: Synthetic oligonucleotide
tcctgacgtctgatcgtccc

SEQ ID NO: 1599 - DNA, 20 bp, Artificial Sequence
  Description of Artificial Sequence: Synthetic oligonucleotide
tcctgacgtctgttcgtaca

SEQ ID NO: 1600 - DNA, 20 bp, Artificial Sequence
  Description of Artificial Sequence: Synthetic oligonucleotide
tcctgacgtctgttcgtctc

SEQ ID NO: 1601 - DNA, 20 bp, Artificial Sequence
  Description of Artificial Sequence: Synthetic oligonucleotide
tcctgccctctgttcgtccc

SEQ ID NO: 1602 - DNA, 20 bp, Artificial Sequence
  Description of Artificial Sequence: Synthetic oligonucleotide
tcctgccgtctgtccgtccc

SEQ ID NO: 1603 - DNA, 20 bp, Artificial Sequence
  Description of Artificial Sequence: Synthetic oligonucleotide
tcctgccgtctgttcgaccc

SEQ ID NO: 1604 - DNA, 20 bp, Artificial Sequence
  Description of Artificial Sequence: Synthetic oligonucleotide
tcctgccgtctgttcgtacc

SEQ ID NO: 1605 - DNA, 20 bp, Artificial Sequence
  Description of Artificial Sequence: Synthetic oligonucleotide
tcctgccgtctgttcgtcca

SEQ ID NO: 1606 - DNA, 20 bp, Artificial Sequence
  Description of Artificial Sequence: Synthetic oligonucleotide
tcctgccgtcttttcgtccc

SEQ ID NO: 1607 - DNA, 20 bp, Artificial Sequence
  Description of Artificial Sequence: Synthetic oligonucleotide
tcctgccgtttgttcgtccc

SEQ ID NO: 1608 - DNA, 19 bp, Artificial Sequence
  Description of Artificial Sequence: Synthetic oligonucleotide
tcctgcttgtcgttgtccc

SEQ ID NO: 1609 - DNA, 20 bp, Artificial Sequence
  Description of Artificial Sequence: Synthetic oligonucleotide
tcctggcggctgttcgtccc

SEQ ID NO: 1610 - DNA, 20 bp, Artificial Sequence
  Description of Artificial Sequence: Synthetic oligonucleotide
tcctggcgtctgttcggccc

SEQ ID NO: 1611 - DNA, 20 bp, Artificial Sequence
  Description of Artificial Sequence: Synthetic oligonucleotide
tcctggctggtcgttgtccc

SEQ ID NO: 1612 - DNA, 20 bp, Artificial Sequence
  Description of Artificial Sequence: Synthetic oligonucleotide
tcctggcttgtcgatgtccc

SEQ ID NO: 1613 - DNA, 19 bp, Artificial Sequence
  Description of Artificial Sequence: Synthetic oligonucleotide
tcctggcttgtcgttgttc

SEQ ID NO: 1614 - DNA, 18 bp, Artificial Sequence
  Description of Artificial Sequence: Synthetic oligonucleotide
tcctggcttgtcgtttcc

SEQ ID NO: 1615 - DNA, 20 bp, Artificial Sequence
  Description of Artificial Sequence: Synthetic oligonucleotide
tcctgggttgtcgttgtccc

SEQ ID NO: 1616 - DNA, 21 bp, Artificial Sequence
  Description of Artificial Sequence: Synthetic oligonucleotide
tcctggtcgtctgttcgtccc

SEQ ID NO: 1617 - DNA, 20 bp, Artificial Sequence
  Description of Artificial Sequence: Synthetic oligonucleotide
tcctgtactctgttcgtccc

SEQ ID NO: 1618 - DNA, 20 bp, Artificial Sequence
  Description of Artificial Sequence: Synthetic oligonucleotide
tcctgtagtcagttcgtccc

SEQ ID NO: 1619 - DNA, 20 bp, Artificial Sequence
  Description of Artificial Sequence: Synthetic oligonucleotide
tcctgtagtccgttcgtccc

SEQ ID NO: 1620 - DNA, 20 bp, Artificial Sequence
  Description of Artificial Sequence: Synthetic oligonucleotide
tcctgtagtctgttagtaca

SEQ ID NO: 1621 - DNA, 20 bp, Artificial Sequence
  Description of Artificial Sequence: Synthetic oligonucleotide
tcctgtagtctgttcgtaac

SEQ ID NO: 1622 - DNA, 20 bp, Artificial Sequence
  Description of Artificial Sequence: Synthetic oligonucleotide
tcctgtagtctgttggtccc

SEQ ID NO: 1623 - DNA, 20 bp, Artificial Sequence
  Description of Artificial Sequence: Synthetic oligonucleotide
tcctgtagtcttttcgtccc

SEQ ID NO: 1624 - DNA, 20 bp, Artificial Sequence
  Description of Artificial Sequence: Synthetic oligonucleotide
tcctgtattctgttcgtccc

SEQ ID NO: 1625 - DNA, 20 bp, Artificial Sequence
  Description of Artificial Sequence: Synthetic oligonucleotide
tcctgtcatctcttcgtccc

SEQ ID NO: 1626 - DNA, 20 bp, Artificial Sequence
  Description of Artificial Sequence: Synthetic oligonucleotide
tcctgtcatctgttcctccc

SEQ ID NO: 1627 - DNA, 20 bp, Artificial Sequence
  Description of Artificial Sequence: Synthetic oligonucleotide
tcctgtcccctgttcgtccc

SEQ ID NO: 1628 - DNA, 19 bp, Artificial Sequence
  Description of Artificial Sequence: Synthetic oligonucleotide
tcctgtccctgttcgtccc

SEQ ID NO: 1629 - DNA, 20 bp, Artificial Sequence
  Description of Artificial Sequence: Synthetic oligonucleotide
tcctgtcgactgttagtcac

SEQ ID NO: 1630 - DNA, 20 bp, Artificial Sequence
  Description of Artificial Sequence: Synthetic oligonucleotide
tcctgtcgcctgatcgtccc

SEQ ID NO: 1631 - DNA, 20 bp, Artificial Sequence
  Description of Artificial Sequence: Synthetic oligonucleotide
tcctgtcgcctgtccgtccc

SEQ ID NO: 1632 - DNA, 20 bp, Artificial Sequence
  Description of Artificial Sequence: Synthetic oligonucleotide
tcctgtcgcctgttcatccc

SEQ ID NO: 1633 - DNA, 20 bp, Artificial Sequence
  Description of Artificial Sequence: Synthetic oligonucleotide
tcctgtcgcctgttcgtcca

SEQ ID NO: 1634 - DNA, 20 bp, Artificial Sequence
  Description of Artificial Sequence: Synthetic oligonucleotide
tcctgtcgcctgttcttccc

SEQ ID NO: 1635 - DNA, 20 bp, Artificial Sequence
  Description of Artificial Sequence: Synthetic oligonucleotide
tcctgtcggctgttcggccc

SEQ ID NO: 1636 - DNA, 20 bp, Artificial Sequence
  Description of Artificial Sequence: Synthetic oligonucleotide
tcctgtcgtacgttcgtccc

SEQ ID NO: 1637 - DNA, 20 bp, Artificial Sequence
  Description of Artificial Sequence: Synthetic oligonucleotide
tcctgtcgtatgatcgtccc

SEQ ID NO: 1638 - DNA, 20 bp, Artificial Sequence
  Description of Artificial Sequence: Synthetic oligonucleotide
tcctgtcgtatggtcgtccc

SEQ ID NO: 1639 - DNA, 20 bp, Artificial Sequence
  Description of Artificial Sequence: Synthetic oligonucleotide
tcctgtcgtatgttcgtaac

SEQ ID NO: 1640 - DNA, 19 bp, Artificial Sequence
  Description of Artificial Sequence: Synthetic oligonucleotide
tcctgtcgtatgttcgtcc

SEQ ID NO: 1641 - DNA, 20 bp, Artificial Sequence
  Description of Artificial Sequence: Synthetic oligonucleotide
tcctgtcgtatgttggtccc

SEQ ID NO: 1642 - DNA, 20 bp, Artificial Sequence
  Description of Artificial Sequence: Synthetic oligonucleotide
tcctgtcgtatgtttgtccc

SEQ ID NO: 1643 - DNA, 20 bp, Artificial Sequence
  Description of Artificial Sequence: Synthetic oligonucleotide
tcctgtcgtcagttcgtacc

SEQ ID NO: 1644 - DNA, 19 bp, Artificial Sequence
  Description of Artificial Sequence: Synthetic oligonucleotide
tcctgtcgtcattcgtccc

SEQ ID NO: 1645 - DNA, 19 bp, Artificial Sequence
  Description of Artificial Sequence: Synthetic oligonucleotide
tcctgtcgtccatcgtccc

SEQ ID NO: 1646 - DNA, 17 bp, Artificial Sequence
  Description of Artificial Sequence: Synthetic oligonucleotide
tcctgtcgtctcgttcc

SEQ ID NO: 1647 - DNA, 20 bp, Artificial Sequence
  Description of Artificial Sequence: Synthetic oligonucleotide
tcctgtcgtctcttcatccc

SEQ ID NO: 1648 - DNA, 17 bp, Artificial Sequence
  Description of Artificial Sequence: Synthetic oligonucleotide
tcctgtcgtctcttccc

SEQ ID NO: 1649 - DNA, 20 bp, Artificial Sequence
  Description of Artificial Sequence: Synthetic oligonucleotide
tcctgtcgtctgatcgaccc

SEQ ID NO: 1650 - DNA, 18 bp, Artificial Sequence
  Description of Artificial Sequence: Synthetic oligonucleotide
tcctgtcgtctgcgtccc

SEQ ID NO: 1651 - DNA, 20 bp, Artificial Sequence
  Description of Artificial Sequence: Synthetic oligonucleotide
tcctgtcgtctgctcgtacc

SEQ ID NO: 1652 - DNA, 19 bp, Artificial Sequence
  Description of Artificial Sequence: Synthetic oligonucleotide
tcctgtcgtctgctcgttc

SEQ ID NO: 1653 - DNA, 20 bp, Artificial Sequence
  Description of Artificial Sequence: Synthetic oligonucleotide
tcctgtcgtctggtcggccc

SEQ ID NO: 1654 - DNA, 19 bp, Artificial Sequence
  Description of Artificial Sequence: Synthetic oligonucleotide
tcctgtcgtctgtactccc

SEQ ID NO: 1655 - DNA, 19 bp, Artificial Sequence
  Description of Artificial Sequence: Synthetic oligonucleotide
tcctgtcgtctgtagtccc

SEQ ID NO: 1656 - DNA, 20 bp, Artificial Sequence
  Description of Artificial Sequence: Synthetic oligonucleotide
tcctgtcgtctgtccgcccc

SEQ ID NO: 1657 - DNA, 20 bp, Artificial Sequence
  Description of Artificial Sequence: Synthetic oligonucleotide
tcctgtcgtctgttagtaaa

SEQ ID NO: 1658 - DNA, 20 bp, Artificial Sequence
  Description of Artificial Sequence: Synthetic oligonucleotide
tcctgtcgtctgttagtcgc

SEQ ID NO: 1659 - DNA, 20 bp, Artificial Sequence
  Description of Artificial Sequence: Synthetic oligonucleotide
tcctgtcgtctgttagtctc

SEQ ID NO: 1660 - DNA, 21 bp, Artificial Sequence
  Description of Artificial Sequence: Synthetic oligonucleotide
tcctgtcgtctgttcactccc

SEQ ID NO: 1661 - DNA, 20 bp, Artificial Sequence
  Description of Artificial Sequence: Synthetic oligonucleotide
tcctgtcgtctgttcatcca

SEQ ID NO: 1662 - DNA, 18 bp, Artificial Sequence
  Description of Artificial Sequence: Synthetic oligonucleotide
tcctgtcgtctgttcgcc

SEQ ID NO: 1663 - DNA, 19 bp, Artificial Sequence
  Description of Artificial Sequence: Synthetic oligonucleotide
tcctgtcgtctgttcgctc

SEQ ID NO: 1664 - DNA, 20 bp, Artificial Sequence
  Description of Artificial Sequence: Synthetic oligonucleotide
tcctgtcgtctgttcggtcc

SEQ ID NO: 1665 - DNA, 20 bp, Artificial Sequence
  Description of Artificial Sequence: Synthetic oligonucleotide
tcctgtcgtctgttcgtacg

SEQ ID NO: 1666 - DNA, 20 bp, Artificial Sequence
  Description of Artificial Sequence: Synthetic oligonucleotide
tcctgtcgtctgttcgtact

SEQ ID NO: 1667 - DNA, 19 bp, Artificial Sequence
  Description of Artificial Sequence: Synthetic oligonucleotide
tcctgtcgtctgttcgtca

SEQ ID NO: 1668 - DNA, 20 bp, Artificial Sequence
  Description of Artificial Sequence: Synthetic oligonucleotide
tcctgtcgtctgttcgtcag

SEQ ID NO: 1669 - DNA, 21 bp, Artificial Sequence
  Description of Artificial Sequence: Synthetic oligonucleotide
tcctgtcgtctgttcgtccac

SEQ ID NO: 1670 - DNA, 20 bp, Artificial Sequence
  Description of Artificial Sequence: Synthetic oligonucleotide
tcctgtcgtctgttcgttgc

SEQ ID NO: 1671 - DNA, 19 bp, Artificial Sequence
  Description of Artificial Sequence: Synthetic oligonucleotide
tcctgtcgtctgttctttc

SEQ ID NO: 1672 - DNA, 20 bp, Artificial Sequence
  Description of Artificial Sequence: Synthetic oligonucleotide
tcctgtcgtctgttggtacc

SEQ ID NO: 1673 - DNA, 20 bp, Artificial Sequence
  Description of Artificial Sequence: Synthetic oligonucleotide
tcctgtcgtctgttggtccg

SEQ ID NO: 1674 - DNA, 20 bp, Artificial Sequence
  Description of Artificial Sequence: Synthetic oligonucleotide
tcctgtcgtctgttggttcc

SEQ ID NO: 1675 - DNA, 18 bp, Artificial Sequence
  Description of Artificial Sequence: Synthetic oligonucleotide
tcctgtcgtctgtttccc

SEQ ID NO: 1676 - DNA, 20 bp, Artificial Sequence
  Description of Artificial Sequence: Synthetic oligonucleotide
tcctgtcgtctgtttgcccc

SEQ ID NO: 1677 - DNA, 19 bp, Artificial Sequence
  Description of Artificial Sequence: Synthetic oligonucleotide
tcctgtcgtctttcgcccc

SEQ ID NO: 1678 - DNA, 19 bp, Artificial Sequence
  Description of Artificial Sequence: Synthetic oligonucleotide
tcctgtcgtctttcgttcc

SEQ ID NO: 1679 - DNA, 20 bp, Artificial Sequence
  Description of Artificial Sequence: Synthetic oligonucleotide
tcctgtcgtgtgttcgtacc

SEQ ID NO: 1680 - DNA, 20 bp, Artificial Sequence
  Description of Artificial Sequence: Synthetic oligonucleotide
tcctgtcgtgtgttcgttcc

SEQ ID NO: 1681 - DNA, 20 bp, Artificial Sequence
  Description of Artificial Sequence: Synthetic oligonucleotide
tcctgtcgtttgttcgtcac

SEQ ID NO: 1682 - DNA, 20 bp, Artificial Sequence
  Description of Artificial Sequence: Synthetic oligonucleotide
tcctgtcttctgttagtccc

SEQ ID NO: 1683 - DNA, 20 bp, Artificial Sequence
  Description of Artificial Sequence: Synthetic oligonucleotide
tcctgttgtatgttcgtccc

SEQ ID NO: 1684 - DNA, 19 bp, Artificial Sequence
  Description of Artificial Sequence: Synthetic oligonucleotide
tcctgttgtctgttcgtcc

SEQ ID NO: 1685 - DNA, 20 bp, Artificial Sequence
  Description of Artificial Sequence: Synthetic oligonucleotide
tcctgttgtctgttcgtcca

SEQ ID NO: 1686 - DNA, 20 bp, Artificial Sequence
  Description of Artificial Sequence: Synthetic oligonucleotide
tcctgttttctgttcgtccc

SEQ ID NO: 1687 - DNA, 20 bp, Artificial Sequence
  Description of Artificial Sequence: Synthetic oligonucleotide
tcctttcgtctgctcgtccc

SEQ ID NO: 1688 - DNA, 20 bp, Artificial Sequence
  Description of Artificial Sequence: Synthetic oligonucleotide
tcctttcgtctgttcgcccc

SEQ ID NO: 1689 - DNA, 20 bp, Artificial Sequence
  Description of Artificial Sequence: Synthetic oligonucleotide
tcctttcgtctgttcgtcac

SEQ ID NO: 1690 - DNA, 20 bp, Artificial Sequence
  Description of Artificial Sequence: Synthetic oligonucleotide
tcgaccgtctgttccgtccc

SEQ ID NO: 1691 - DNA, 20 bp, Artificial Sequence
  Description of Artificial Sequence: Synthetic oligonucleotide
tcgagcgtctttctcgtccc

SEQ ID NO: 1692 - DNA, 22 bp, Artificial Sequence
  Description of Artificial Sequence: Synthetic oligonucleotide
tcgatcgtctgattttcgtccc

SEQ ID NO: 1693 - DNA, 20 bp, Artificial Sequence
  Description of Artificial Sequence: Synthetic oligonucleotide
tcgggtctctgttcactccc

SEQ ID NO: 1694 - DNA, 20 bp, Artificial Sequence
  Description of Artificial Sequence: Synthetic oligonucleotide
tcgtctcgtctgcactcccc

SEQ ID NO: 1695 - DNA, 20 bp, Artificial Sequence
  Description of Artificial Sequence: Synthetic oligonucleotide
tcgtctgttgtacgcctccc

SEQ ID NO: 1696 - DNA, 20 bp, Artificial Sequence
  Description of Artificial Sequence: Synthetic oligonucleotide
tcgttgtcgcctgacctccc

SEQ ID NO: 1697 - DNA, 20 bp, Artificial Sequence
  Description of Artificial Sequence: Synthetic oligonucleotide
tctcagcagtgggcctgctg

SEQ ID NO: 1698 - DNA, 20 bp, Artificial Sequence
  Description of Artificial Sequence: Synthetic oligonucleotide
tctctgtgctattcccacgc

SEQ ID NO: 1699 - DNA, 19 bp, Artificial Sequence
  Description of Artificial Sequence: Synthetic oligonucleotide
tctgcgtgggatgtggccc

SEQ ID NO: 1700 - DNA, 20 bp, Artificial Sequence
  Description of Artificial Sequence: Synthetic oligonucleotide
tctgtctggtttgtcctcgc

SEQ ID NO: 1701 - DNA, 19 bp, Artificial Sequence
  Description of Artificial Sequence: Synthetic oligonucleotide
tctgtgtgggatctggccc

SEQ ID NO: 1702 - DNA, 19 bp, Artificial Sequence
  Description of Artificial Sequence: Synthetic oligonucleotide
tctgtgtggggtgtggccc

SEQ ID NO: 1703 - DNA, 20 bp, Artificial Sequence
  Description of Artificial Sequence: Synthetic oligonucleotide
tcttctgggtttctcggccc

SEQ ID NO: 1704 - DNA, 20 bp, Artificial Sequence
  Description of Artificial Sequence: Synthetic oligonucleotide
tcttctggtgttcctgccgc

SEQ ID NO: 1705 - DNA, 20 bp, Artificial Sequence
  Description of Artificial Sequence: Synthetic oligonucleotide
tcttgacgtctgttcgtccc

SEQ ID NO: 1706 - DNA, 20 bp, Artificial Sequence
  Description of Artificial Sequence: Synthetic oligonucleotide
tcttgtagtctgttcgtccc

SEQ ID NO: 1707 - DNA, 20 bp, Artificial Sequence
  Description of Artificial Sequence: Synthetic oligonucleotide
tcttgtcctctgttcgtccc

SEQ ID NO: 1708 - DNA, 20 bp, Artificial Sequence
  Description of Artificial Sequence: Synthetic oligonucleotide
tcttgtcggctgttcgtccc

SEQ ID NO: 1709 - DNA, 20 bp, Artificial Sequence
  Description of Artificial Sequence: Synthetic oligonucleotide
tcttgtcgtctgttcgtgcc

SEQ ID NO: 1710 - DNA, 19 bp, Artificial Sequence
  Description of Artificial Sequence: Synthetic oligonucleotide
tcttgtcgtctttcgtccc

SEQ ID NO: 1711 - DNA, 20 bp, Artificial Sequence
  Description of Artificial Sequence: Synthetic oligonucleotide
tcttgtcgttctgttgtccc

SEQ ID NO: 1712 - DNA, 20 bp, Artificial Sequence
  Description of Artificial Sequence: Synthetic oligonucleotide
tctttcgtctggttcgtccc

SEQ ID NO: 1713 - DNA, 20 bp, Artificial Sequence
  Description of Artificial Sequence: Synthetic oligonucleotide
tctttgggtttgtgctgccc

SEQ ID NO: 1714 - DNA, 20 bp, Artificial Sequence
  Description of Artificial Sequence: Synthetic oligonucleotide
tgacctcgtctgcacctccc

SEQ ID NO: 1715 - DNA, 20 bp, Artificial Sequence
  Description of Artificial Sequence: Synthetic oligonucleotide
tgactcgtctgtttcgttcc

SEQ ID NO: 1716 - DNA, 20 bp, Artificial Sequence
  Description of Artificial Sequence: Synthetic oligonucleotide
tgagtcattcccttcgtccc

SEQ ID NO: 1717 - DNA, 20 bp, Artificial Sequence
  Description of Artificial Sequence: Synthetic oligonucleotide
tgagtcgttcccttcctccc

SEQ ID NO: 1718 - DNA, 20 bp, Artificial Sequence
  Description of Artificial Sequence: Synthetic oligonucleotide
tgagtcgttcttttcgtccc

SEQ ID NO: 1719 - DNA, 20 bp, Artificial Sequence
  Description of Artificial Sequence: Synthetic oligonucleotide
tgagtcgtttcattcgtccc

SEQ ID NO: 1720 - DNA, 20 bp, Artificial Sequence
  Description of Artificial Sequence: Synthetic oligonucleotide
tgagtcgttttcttcgtccc

SEQ ID NO: 1721 - DNA, 20 bp, Artificial Sequence
  Description of Artificial Sequence: Synthetic oligonucleotide
tgcctgtcttctgcgctccc

SEQ ID NO: 1722 - DNA, 20 bp, Artificial Sequence
  Description of Artificial Sequence: Synthetic oligonucleotide
tgcctttcgtctgcgctccc

SEQ ID NO: 1723 - DNA, 20 bp, Artificial Sequence
  Description of Artificial Sequence: Synthetic oligonucleotide
tgcgacgtctgttttctccc

SEQ ID NO: 1724 - DNA, 20 bp, Artificial Sequence
  Description of Artificial Sequence: Synthetic oligonucleotide
tgcgactcgtcactcctccc

SEQ ID NO: 1725 - DNA, 20 bp, Artificial Sequence
  Description of Artificial Sequence: Synthetic oligonucleotide
tgcgactcgtcactcgtccc

SEQ ID NO: 1726 - DNA, 20 bp, Artificial Sequence
  Description of Artificial Sequence: Synthetic oligonucleotide
tgcgtttcgtcagctctccc

SEQ ID NO: 1727 - DNA, 20 bp, Artificial Sequence
  Description of Artificial Sequence: Synthetic oligonucleotide
tgcgtttcgtcgattgcctc

SEQ ID NO: 1728 - DNA, 20 bp, Artificial Sequence
  Description of Artificial Sequence: Synthetic oligonucleotide
tgctgtcgcctgttcgtccc

SEQ ID NO: 1729 - DNA, 20 bp, Artificial Sequence
  Description of Artificial Sequence: Synthetic oligonucleotide
tgctgtcgtctgtccgtccc

SEQ ID NO: 1730 - DNA, 19 bp, Artificial Sequence
  Description of Artificial Sequence: Synthetic oligonucleotide
tgctgtcgtctgtcgtccc

SEQ ID NO: 1731 - DNA, 20 bp, Artificial Sequence
  Description of Artificial Sequence: Synthetic oligonucleotide
tgctgtcgtctgttcgtacc

SEQ ID NO: 1732 - DNA, 20 bp, Artificial Sequence
  Description of Artificial Sequence: Synthetic oligonucleotide
tgctgtcgtctgttcgtcca

SEQ ID NO: 1733 - DNA, 20 bp, Artificial Sequence
  Description of Artificial Sequence: Synthetic oligonucleotide
tgtcggttgtctgatctccc

SEQ ID NO: 1734 - DNA, 20 bp, Artificial Sequence
  Description of Artificial Sequence: Synthetic oligonucleotide
tgtcgtagcctatccgcccg

SEQ ID NO: 1735 - DNA, 20 bp, Artificial Sequence
  Description of Artificial Sequence: Synthetic oligonucleotide
tgtcgttctggttgtcccgc

SEQ ID NO: 1736 - DNA, 20 bp, Artificial Sequence
  Description of Artificial Sequence: Synthetic oligonucleotide
tgtctcgtctgcgctctccc

SEQ ID NO: 1737 - DNA, 20 bp, Artificial Sequence
  Description of Artificial Sequence: Synthetic oligonucleotide
ttcgtctgcgttcctccggc

SEQ ID NO: 1738 - DNA, 20 bp, Artificial Sequence
  Description of Artificial Sequence: Synthetic oligonucleotide
ttcgtctggttttggcgcgc

SEQ ID NO: 1739 - DNA, 19 bp, Artificial Sequence
  Description of Artificial Sequence: Synthetic oligonucleotide
ttctgtcgtctgttcgtcc

SEQ ID NO: 1740 - DNA, 19 bp, Artificial Sequence
  Description of Artificial Sequence: Synthetic oligonucleotide
tttggggtttcccctgccc

SEQ ID NO: 1741 - DNA, 20 bp, Artificial Sequence
  Description of Artificial Sequence: Synthetic oligonucleotide
tttggggttttcccgtgttc

SEQ ID NO: 1742 - DNA, 20 bp, Artificial Sequence
  Description of Artificial Sequence: Synthetic oligonucleotide
tttggggttttttcgtgccc

SEQ ID NO: 1743 - DNA, 20 bp, Artificial Sequence
  Description of Artificial Sequence: Synthetic oligonucleotide
ttttggcttgtcgttgtccc

SEQ ID NO: 1744 - DNA, 20 bp, Artificial Sequence
  Description of Artificial Sequence: Synthetic oligonucleotide
actcacacattcccggtgtg

SEQ ID NO: 1745 - DNA, 21 bp, Artificial Sequence
  Description of Artificial Sequence: Synthetic oligonucleotide
actggtgttttgttcccgcgc

SEQ ID NO: 1746 - DNA, 20 bp, Artificial Sequence
  Description of Artificial Sequence: Synthetic oligonucleotide
gcctttcgtcgatgactccc

SEQ ID NO: 1747 - DNA, 20 bp, Artificial Sequence
  Description of Artificial Sequence: Synthetic oligonucleotide
tatggggttttcccgtgccc

SEQ ID NO: 1748 - DNA, 20 bp, Artificial Sequence
  Description of Artificial Sequence: Synthetic oligonucleotide
tattgttttctgtcgttgtg

SEQ ID NO: 1749 - DNA, 19 bp, Artificial Sequence
  Description of Artificial Sequence: Synthetic oligonucleotide
tcctggcttgtgttgtccc

SEQ ID NO: 1750 - DNA, 20 bp, Artificial Sequence
  Description of Artificial Sequence: Synthetic oligonucleotide
tctgacgtttgttcccgcgc

SEQ ID NO: 1751 - DNA, 20 bp, Artificial Sequence
  Description of Artificial Sequence: Synthetic oligonucleotide
tcttgtgctgtttgtggcgc

SEQ ID NO: 1752 - DNA, 20 bp, Artificial Sequence
  Description of Artificial Sequence: Synthetic oligonucleotide
tttggcgttttcccgtgccc

SEQ ID NO: 1753 - DNA, 20 bp, Artificial Sequence
  Description of Artificial Sequence: Synthetic oligonucleotide
tttgggcttttcccgtgccc

SEQ ID NO: 1754 - DNA, 21 bp, Artificial Sequence
  Description of Artificial Sequence: Synthetic oligonucleotide
tttggggtttatcccgtgccc

SEQ ID NO: 1755 - DNA, 20 bp, Artificial Sequence
  Description of Artificial Sequence: Synthetic oligonucleotide
tttggggtttctctcggccc

SEQ ID NO: 1756 - DNA, 20 bp, Artificial Sequence
  Description of Artificial Sequence: Synthetic oligonucleotide
tttggggtttgtccctgccc

SEQ ID NO: 1757 - DNA, 20 bp, Artificial Sequence
  Description of Artificial Sequence: Synthetic oligonucleotide
tttggggttttcacccgccc

SEQ ID NO: 1758 - DNA, 20 bp, Artificial Sequence
  Description of Artificial Sequence: Synthetic oligonucleotide
tttggggttttcccgagccc

SEQ ID NO: 1759 - DNA, 20 bp, Artificial Sequence
  Description of Artificial Sequence: Synthetic oligonucleotide
tttggggttttcccgtgcac

SEQ ID NO: 1760 - DNA, 21 bp, Artificial Sequence
  Description of Artificial Sequence: Synthetic oligonucleotide
tttgttgtgcttgatatgccc

SEQ ID NO: 1761 - DNA, 20 bp, Artificial Sequence
  Description of Artificial Sequence: Synthetic oligonucleotide
caatgcttacgtgcacgcgc

SEQ ID NO: 1762 - DNA, 20 bp, Artificial Sequence
  Description of Artificial Sequence: Synthetic oligonucleotide
cttgcgatattcccggtcgc

SEQ ID NO: 1763 - DNA, 19 bp, Artificial Sequence
  Description of Artificial Sequence: Synthetic oligonucleotide
tttggggtacttcccgccc

SEQ ID NO: 1764 - DNA, 20 bp, Artificial Sequence
  Description of Artificial Sequence: Synthetic oligonucleotide
tttggggtgtttccccgccc

SEQ ID NO: 1765 - DNA, 20 bp, Artificial Sequence
  Description of Artificial Sequence: Synthetic oligonucleotide
tttggggtttttgcccgccc

SEQ ID NO: 1766 - DNA, 20 bp, Artificial Sequence
  Description of Artificial Sequence: Synthetic oligonucleotide
aacattggggggggtgttcc

SEQ ID NO: 1767 - DNA, 20 bp, Artificial Sequence
  Description of Artificial Sequence: Synthetic oligonucleotide
acatgacgtctgttcgtccc

SEQ ID NO: 1768 - DNA, 20 bp, Artificial Sequence
  Description of Artificial Sequence: Synthetic oligonucleotide
acctgatcgtctgagctccc

SEQ ID NO: 1769 - DNA, 20 bp, Artificial Sequence
  Description of Artificial Sequence: Synthetic oligonucleotide
acctgtagtatgttcgtccc

SEQ ID NO: 1770 - DNA, 20 bp, Artificial Sequence
  Description of Artificial Sequence: Synthetic oligonucleotide
acctgtagtctgttcgtcac

SEQ ID NO: 1771 - DNA, 20 bp, Artificial Sequence
  Description of Artificial Sequence: Synthetic oligonucleotide
acctgtagtctgttcgtcca

SEQ ID NO: 1772 - DNA, 20 bp, Artificial Sequence
  Description of Artificial Sequence: Synthetic oligonucleotide
acctgtcgtctgttagtcac

SEQ ID NO: 1773 - DNA, 20 bp, Artificial Sequence
  Description of Artificial Sequence: Synthetic oligonucleotide
acctgtcgtctgttcgtaca

SEQ ID NO: 1774 - DNA, 20 bp, Artificial Sequence
  Description of Artificial Sequence: Synthetic oligonucleotide
acgactcgtctacacctccc

SEQ ID NO: 1775 - DNA, 20 bp, Artificial Sequence
  Description of Artificial Sequence: Synthetic oligonucleotide
acgactcgtctcacgctccc

SEQ ID NO: 1776 - DNA, 20 bp, Artificial Sequence
  Description of Artificial Sequence: Synthetic oligonucleotide
acgatcttctggctcctccc

SEQ ID NO: 1777 - DNA, 20 bp, Artificial Sequence
  Description of Artificial Sequence: Synthetic oligonucleotide
acgtctcgtctgtgggccgc

SEQ ID NO: 1778 - DNA, 20 bp, Artificial Sequence
  Description of Artificial Sequence: Synthetic oligonucleotide
agagtccgtctgttggccgc

SEQ ID NO: 1779 - DNA, 20 bp, Artificial Sequence
  Description of Artificial Sequence: Synthetic oligonucleotide
agagtcgttcccttcgtccc

SEQ ID NO: 1780 - DNA, 20 bp, Artificial Sequence
  Description of Artificial Sequence: Synthetic oligonucleotide
agtttcctctggttcgtccc

SEQ ID NO: 1781 - DNA, 20 bp, Artificial Sequence
  Description of Artificial Sequence: Synthetic oligonucleotide
atgatttcgtctgtactccc

SEQ ID NO: 1782 - DNA, 20 bp, Artificial Sequence
  Description of Artificial Sequence: Synthetic oligonucleotide
attaacctcccttccgcatc

SEQ ID NO: 1783 - DNA, 20 bp, Artificial Sequence
  Description of Artificial Sequence: Synthetic oligonucleotide
cacgagttcgtctcactccc

SEQ ID NO: 1784 - DNA, 20 bp, Artificial Sequence
  Description of Artificial Sequence: Synthetic oligonucleotide
cacgtccttcactccctccc

SEQ ID NO: 1785 - DNA, 20 bp, Artificial Sequence
  Description of Artificial Sequence: Synthetic oligonucleotide
cagtcgatctgattcttccc

SEQ ID NO: 1786 - DNA, 20 bp, Artificial Sequence
  Description of Artificial Sequence: Synthetic oligonucleotide
cagtcggctgttttccgccc

SEQ ID NO: 1787 - DNA, 20 bp, Artificial Sequence
  Description of Artificial Sequence: Synthetic oligonucleotide
catgacttgctgcgttggtc

SEQ ID NO: 1788 - DNA, 20 bp, Artificial Sequence
  Description of Artificial Sequence: Synthetic oligonucleotide
catgttcgtctgcccctccc

SEQ ID NO: 1789 - DNA, 20 bp, Artificial Sequence
  Description of Artificial Sequence: Synthetic oligonucleotide
cattcgtctgattacctccc

SEQ ID NO: 1790 - DNA, 20 bp, Artificial Sequence
  Description of Artificial Sequence: Synthetic oligonucleotide
catttcgtctgttggcgccc

SEQ ID NO: 1791 - DNA, 20 bp, Artificial Sequence
  Description of Artificial Sequence: Synthetic oligonucleotide
ccactcgtctgctcactccc

SEQ ID NO: 1792 - DNA, 20 bp, Artificial Sequence
  Description of Artificial Sequence: Synthetic oligonucleotide
ccactcttccttaccctccc

SEQ ID NO: 1793 - DNA, 20 bp, Artificial Sequence
  Description of Artificial Sequence: Synthetic oligonucleotide
ccagctcgttctgtgctccc

SEQ ID NO: 1794 - DNA, 20 bp, Artificial Sequence
  Description of Artificial Sequence: Synthetic oligonucleotide
ccagtctctgcttacctccc

SEQ ID NO: 1795 - DNA, 20 bp, Artificial Sequence
  Description of Artificial Sequence: Synthetic oligonucleotide
ccagttgttctgtgtccccc

SEQ ID NO: 1796 - DNA, 20 bp, Artificial Sequence
  Description of Artificial Sequence: Synthetic oligonucleotide
ccatatcctccttccctccc

SEQ ID NO: 1797 - DNA, 20 bp, Artificial Sequence
  Description of Artificial Sequence: Synthetic oligonucleotide
ccccatttccttctcccccc

SEQ ID NO: 1798 - DNA, 20 bp, Artificial Sequence
  Description of Artificial Sequence: Synthetic oligonucleotide
ccccttcgtcctttcctccc

SEQ ID NO: 1799 - DNA, 20 bp, Artificial Sequence
  Description of Artificial Sequence: Synthetic oligonucleotide
cccgtcgtctgttatccccc

SEQ ID NO: 1800 - DNA, 20 bp, Artificial Sequence
  Description of Artificial Sequence: Synthetic oligonucleotide
cccgttgtctggtactcccc

SEQ ID NO: 1801 - DNA, 20 bp, Artificial Sequence
  Description of Artificial Sequence: Synthetic oligonucleotide
cccgttgtctgtttcctccc

SEQ ID NO: 1802 - DNA, 20 bp, Artificial Sequence
  Description of Artificial Sequence: Synthetic oligonucleotide
ccctcgtctggtttcgtccc

SEQ ID NO: 1803 - DNA, 20 bp, Artificial Sequence
  Description of Artificial Sequence: Synthetic oligonucleotide
ccctgtcgtcggttcgtccc

SEQ ID NO: 1804 - DNA, 20 bp, Artificial Sequence
  Description of Artificial Sequence: Synthetic oligonucleotide
ccctgtcgtctggtcgtccc

SEQ ID NO: 1805 - DNA, 20 bp, Artificial Sequence
  Description of Artificial Sequence: Synthetic oligonucleotide
ccctgtcgtctgtgcgtccc

SEQ ID NO: 1806 - DNA, 20 bp, Artificial Sequence
  Description of Artificial Sequence: Synthetic oligonucleotide
ccctgtcgtctgttcggttc

SEQ ID NO: 1807 - DNA, 21 bp, Artificial Sequence
  Description of Artificial Sequence: Synthetic oligonucleotide
ccctgtcgtctgtttcgtccc

SEQ ID NO: 1808 - DNA, 20 bp, Artificial Sequence
  Description of Artificial Sequence: Synthetic oligonucleotide
ccctgtcgtctgtttctccc

SEQ ID NO: 1809 - DNA, 20 bp, Artificial Sequence
  Description of Artificial Sequence: Synthetic oligonucleotide
ccctgtggtctgttcgtccc

SEQ ID NO: 1810 - DNA, 20 bp, Artificial Sequence
  Description of Artificial Sequence: Synthetic oligonucleotide
ccctttcgtctgttctgccc

SEQ ID NO: 1811 - DNA, 20 bp, Artificial Sequence
  Description of Artificial Sequence: Synthetic oligonucleotide
ccgaactcgtttgcactccc

SEQ ID NO: 1812 - DNA, 20 bp, Artificial Sequence
  Description of Artificial Sequence: Synthetic oligonucleotide
ccgaagtcgtctaccctccc

SEQ ID NO: 1813 - DNA, 20 bp, Artificial Sequence
  Description of Artificial Sequence: Synthetic oligonucleotide
ccgactctctgtttccaccc

SEQ ID NO: 1814 - DNA, 20 bp, Artificial Sequence
  Description of Artificial Sequence: Synthetic oligonucleotide
ccgagtctgtctttcgtccc

SEQ ID NO: 1815 - DNA, 20 bp, Artificial Sequence
  Description of Artificial Sequence: Synthetic oligonucleotide
ccgcaacgttcaactctccc

SEQ ID NO: 1816 - DNA, 20 bp, Artificial Sequence
  Description of Artificial Sequence: Synthetic oligonucleotide
ccgcaatcctcttttgtccc

SEQ ID NO: 1817 - DNA, 20 bp, Artificial Sequence
  Description of Artificial Sequence: Synthetic oligonucleotide
ccgcacctatcctcgtaccc

SEQ ID NO: 1818 - DNA, 20 bp, Artificial Sequence
  Description of Artificial Sequence: Synthetic oligonucleotide
ccgcacgttttttccgcccc

SEQ ID NO: 1819 - DNA, 20 bp, Artificial Sequence
  Description of Artificial Sequence: Synthetic oligonucleotide
ccgcacttcactccactccc

SEQ ID NO: 1820 - DNA, 20 bp, Artificial Sequence
  Description of Artificial Sequence: Synthetic oligonucleotide
ccgcacttccttgctctccc

SEQ ID NO: 1821 - DNA, 20 bp, Artificial Sequence
  Description of Artificial Sequence: Synthetic oligonucleotide
ccgcatgcttctcctctccc

SEQ ID NO: 1822 - DNA, 20 bp, Artificial Sequence
  Description of Artificial Sequence: Synthetic oligonucleotide
ccgcatttcctcaccctccc

SEQ ID NO: 1823 - DNA, 20 bp, Artificial Sequence
  Description of Artificial Sequence: Synthetic oligonucleotide
ccgccacgtcttcttctccc

SEQ ID NO: 1824 - DNA, 20 bp, Artificial Sequence
  Description of Artificial Sequence: Synthetic oligonucleotide
ccgcctcttgaaaagtcccc

SEQ ID NO: 1825 - DNA, 20 bp, Artificial Sequence
  Description of Artificial Sequence: Synthetic oligonucleotide
ccgcgatctctcttgtcccc

SEQ ID NO: 1826 - DNA, 20 bp, Artificial Sequence
  Description of Artificial Sequence: Synthetic oligonucleotide
ccgcgtccttttaccctccc

SEQ ID NO: 1827 - DNA, 20 bp, Artificial Sequence
  Description of Artificial Sequence: Synthetic oligonucleotide
ccgcgtccttttgttacccc

SEQ ID NO: 1828 - DNA, 20 bp, Artificial Sequence
  Description of Artificial Sequence: Synthetic oligonucleotide
ccgctacttctttccccccc

SEQ ID NO: 1829 - DNA, 20 bp, Artificial Sequence
  Description of Artificial Sequence: Synthetic oligonucleotide
ccggtcgtctctatcgtccc

SEQ ID NO: 1830 - DNA, 20 bp, Artificial Sequence
  Description of Artificial Sequence: Synthetic oligonucleotide
ccggtcttctgtaacctccc

SEQ ID NO: 1831 - DNA, 20 bp, Artificial Sequence
  Description of Artificial Sequence: Synthetic oligonucleotide
ccggtcttctgtctcctccc

SEQ ID NO: 1832 - DNA, 20 bp, Artificial Sequence
  Description of Artificial Sequence: Synthetic oligonucleotide
ccgtagttgtcttacctccc

SEQ ID NO: 1833 - DNA, 20 bp, Artificial Sequence
  Description of Artificial Sequence: Synthetic oligonucleotide
ccgtcatgtctttccctccc

SEQ ID NO: 1834 - DNA, 20 bp, Artificial Sequence
  Description of Artificial Sequence: Synthetic oligonucleotide
ccgtctcgtcttttcctccc

SEQ ID NO: 1835 - DNA, 20 bp, Artificial Sequence
  Description of Artificial Sequence: Synthetic oligonucleotide
ccgtgttgtttgatgctccc

SEQ ID NO: 1836 - DNA, 20 bp, Artificial Sequence
  Description of Artificial Sequence: Synthetic oligonucleotide
cctaagatcttccccctccc

SEQ ID NO: 1837 - DNA, 20 bp, Artificial Sequence
  Description of Artificial Sequence: Synthetic oligonucleotide
cctagtcctccggcagtctg

SEQ ID NO: 1838 - DNA, 20 bp, Artificial Sequence
  Description of Artificial Sequence: Synthetic oligonucleotide
cctagttcgtctgacctccc

SEQ ID NO: 1839 - DNA, 20 bp, Artificial Sequence
  Description of Artificial Sequence: Synthetic oligonucleotide
cctcgtctgatttctctccc

SEQ ID NO: 1840 - DNA, 20 bp, Artificial Sequence
  Description of Artificial Sequence: Synthetic oligonucleotide
cctctttcgtctgacctccc

SEQ ID NO: 1841 - DNA, 19 bp, Artificial Sequence
  Description of Artificial Sequence: Synthetic oligonucleotide
cctgccgtctgttcgtccc

SEQ ID NO: 1842 - DNA, 20 bp, Artificial Sequence
  Description of Artificial Sequence: Synthetic oligonucleotide
cctgtcgtctcaaacgtccc

SEQ ID NO: 1843 - DNA, 19 bp, Artificial Sequence
  Description of Artificial Sequence: Synthetic oligonucleotide
cctgtcgtctgttcgtcct

SEQ ID NO: 1844 - DNA, 19 bp, Artificial Sequence
  Description of Artificial Sequence: Synthetic oligonucleotide
cctgtcgtctgttcttccc

SEQ ID NO: 1845 - DNA, 20 bp, Artificial Sequence
  Description of Artificial Sequence: Synthetic oligonucleotide
cctgtcgtcttacgcgtccc

SEQ ID NO: 1846 - DNA, 20 bp, Artificial Sequence
  Description of Artificial Sequence: Synthetic oligonucleotide
cctgtcttctgttagctccc

SEQ ID NO: 1847 - DNA, 20 bp, Artificial Sequence
  Description of Artificial Sequence: Synthetic oligonucleotide
cctgttcgtcttgcgctccc

SEQ ID NO: 1848 - DNA, 20 bp, Artificial Sequence
  Description of Artificial Sequence: Synthetic oligonucleotide
cctgttgtctggctcctccc

SEQ ID NO: 1849 - DNA, 21 bp, Artificial Sequence
  Description of Artificial Sequence: Synthetic oligonucleotide
cctgttgtgcttgatatgccc

SEQ ID NO: 1850 - DNA, 20 bp, Artificial Sequence
  Description of Artificial Sequence: Synthetic oligonucleotide
ccttcgtctgattccttccc

SEQ ID NO: 1851 - DNA, 20 bp, Artificial Sequence
  Description of Artificial Sequence: Synthetic oligonucleotide
ccttcgtctgttaggctccc

SEQ ID NO: 1852 - DNA, 20 bp, Artificial Sequence
  Description of Artificial Sequence: Synthetic oligonucleotide
cctttcgtctggtctccccc

SEQ ID NO: 1853 - DNA, 20 bp, Artificial Sequence
  Description of Artificial Sequence: Synthetic oligonucleotide
cctttcgtctggtgctcccc

SEQ ID NO: 1854 - DNA, 20 bp, Artificial Sequence
  Description of Artificial Sequence: Synthetic oligonucleotide
cctttcgtctgtaagctccc

SEQ ID NO: 1855 - DNA, 20 bp, Artificial Sequence
  Description of Artificial Sequence: Synthetic oligonucleotide
cctttcgtctgtagcctccg

SEQ ID NO: 1856 - DNA, 19 bp, Artificial Sequence
  Description of Artificial Sequence: Synthetic oligonucleotide
cctttcgttctgacctccc

SEQ ID NO: 1857 - DNA, 20 bp, Artificial Sequence
  Description of Artificial Sequence: Synthetic oligonucleotide
cgacccctctgttccctccc

SEQ ID NO: 1858 - DNA, 20 bp, Artificial Sequence
  Description of Artificial Sequence: Synthetic oligonucleotide
cgacctcgtcttgtgtcccc

SEQ ID NO: 1859 - DNA, 20 bp, Artificial Sequence
  Description of Artificial Sequence: Synthetic oligonucleotide
cgacgttgctctgcgctccc

SEQ ID NO: 1860 - DNA, 20 bp, Artificial Sequence
  Description of Artificial Sequence: Synthetic oligonucleotide
cgactactctggctcctccc

SEQ ID NO: 1861 - DNA, 20 bp, Artificial Sequence
  Description of Artificial Sequence: Synthetic oligonucleotide
cgactcctcagttccctccc

SEQ ID NO: 1862 - DNA, 20 bp, Artificial Sequence
  Description of Artificial Sequence: Synthetic oligonucleotide
cgactcctctgatccttccc

SEQ ID NO: 1863 - DNA, 20 bp, Artificial Sequence
  Description of Artificial Sequence: Synthetic oligonucleotide
cgactcctctgccttctccc

SEQ ID NO: 1864 - DNA, 17 bp, Artificial Sequence
  Description of Artificial Sequence: Synthetic oligonucleotide
cgactcctctgttcccc

SEQ ID NO: 1865 - DNA, 20 bp, Artificial Sequence
  Description of Artificial Sequence: Synthetic oligonucleotide
cgactcctctgttcctcccc

SEQ ID NO: 1866 - DNA, 20 bp, Artificial Sequence
  Description of Artificial Sequence: Synthetic oligonucleotide
cgactcggtcttttcgtccc

SEQ ID NO: 1867 - DNA, 20 bp, Artificial Sequence
  Description of Artificial Sequence: Synthetic oligonucleotide
cgactcgtactgctcttccc

SEQ ID NO: 1868 - DNA, 20 bp, Artificial Sequence
  Description of Artificial Sequence: Synthetic oligonucleotide
cgactcgtcatgctgtcccc

SEQ ID NO: 1869 - DNA, 20 bp, Artificial Sequence
  Description of Artificial Sequence: Synthetic oligonucleotide
cgactctctggattcgtccc

SEQ ID NO: 1870 - DNA, 20 bp, Artificial Sequence
  Description of Artificial Sequence: Synthetic oligonucleotide
cgacttcgtctgaacctccc

SEQ ID NO: 1871 - DNA, 20 bp, Artificial Sequence
  Description of Artificial Sequence: Synthetic oligonucleotide
cgagctctctgttttctccc

SEQ ID NO: 1872 - DNA, 20 bp, Artificial Sequence
  Description of Artificial Sequence: Synthetic oligonucleotide
cgagcttctgacgccatccc

SEQ ID NO: 1873 - DNA, 20 bp, Artificial Sequence
  Description of Artificial Sequence: Synthetic oligonucleotide
cgagcttctgtgtttctccc

SEQ ID NO: 1874 - DNA, 20 bp, Artificial Sequence
  Description of Artificial Sequence: Synthetic oligonucleotide
cgatcggttctgaccctccc

SEQ ID NO: 1875 - DNA, 20 bp, Artificial Sequence
  Description of Artificial Sequence: Synthetic oligonucleotide
cgatctgggtaccgcatccc

SEQ ID NO: 1876 - DNA, 20 bp, Artificial Sequence
  Description of Artificial Sequence: Synthetic oligonucleotide
cgatcttcgtctgcactccc

SEQ ID NO: 1877 - DNA, 20 bp, Artificial Sequence
  Description of Artificial Sequence: Synthetic oligonucleotide
cgatgtctctgtcccgtccc

SEQ ID NO: 1878 - DNA, 20 bp, Artificial Sequence
  Description of Artificial Sequence: Synthetic oligonucleotide
cgattcctctgaatcccccc

SEQ ID NO: 1879 - DNA, 20 bp, Artificial Sequence
  Description of Artificial Sequence: Synthetic oligonucleotide
cgattcgatcttttcgtccc

SEQ ID NO: 1880 - DNA, 20 bp, Artificial Sequence
  Description of Artificial Sequence: Synthetic oligonucleotide
cgattcgttcttaacctccc

SEQ ID NO: 1881 - DNA, 20 bp, Artificial Sequence
  Description of Artificial Sequence: Synthetic oligonucleotide
cgcagttctctggacctccc

SEQ ID NO: 1882 - DNA, 20 bp, Artificial Sequence
  Description of Artificial Sequence: Synthetic oligonucleotide
cgcctcgttctgcgactccc

SEQ ID NO: 1883 - DNA, 20 bp, Artificial Sequence
  Description of Artificial Sequence: Synthetic oligonucleotide
cgcctctcgtctgagctccc

SEQ ID NO: 1884 - DNA, 20 bp, Artificial Sequence
  Description of Artificial Sequence: Synthetic oligonucleotide
cgcctctcgtctgctctccc

SEQ ID NO: 1885 - DNA, 20 bp, Artificial Sequence
  Description of Artificial Sequence: Synthetic oligonucleotide
cgcctttcgtctgacctccc

SEQ ID NO: 1886 - DNA, 20 bp, Artificial Sequence
  Description of Artificial Sequence: Synthetic oligonucleotide
cgcgaatcctctgcactccc

SEQ ID NO: 1887 - DNA, 20 bp, Artificial Sequence
  Description of Artificial Sequence: Synthetic oligonucleotide
cgctgtcgtctgttcgtccc

SEQ ID NO: 1888 - DNA, 20 bp, Artificial Sequence
  Description of Artificial Sequence: Synthetic oligonucleotide
cgcttcaactggaccttccc

SEQ ID NO: 1889 - DNA, 20 bp, Artificial Sequence
  Description of Artificial Sequence: Synthetic oligonucleotide
cgcttcgatctgttcgtccc

SEQ ID NO: 1890 - DNA, 20 bp, Artificial Sequence
  Description of Artificial Sequence: Synthetic oligonucleotide
cgcttcttctggaccctccc

SEQ ID NO: 1891 - DNA, 20 bp, Artificial Sequence
  Description of Artificial Sequence: Synthetic oligonucleotide
cggctcgtctgaaacctccc

SEQ ID NO: 1892 - DNA, 20 bp, Artificial Sequence
  Description of Artificial Sequence: Synthetic oligonucleotide
cgggtcctctttctcgtccc

SEQ ID NO: 1893 - DNA, 20 bp, Artificial Sequence
  Description of Artificial Sequence: Synthetic oligonucleotide
cggtcctctgattccctccc

SEQ ID NO: 1894 - DNA, 20 bp, Artificial Sequence
  Description of Artificial Sequence: Synthetic oligonucleotide
cggtcctctgttctcctccc

SEQ ID NO: 1895 - DNA, 20 bp, Artificial Sequence
  Description of Artificial Sequence: Synthetic oligonucleotide
cggtcgacgctgcgttggtc

SEQ ID NO: 1896 - DNA, 20 bp, Artificial Sequence
  Description of Artificial Sequence: Synthetic oligonucleotide
cggtcttctgtaacgctccc

SEQ ID NO: 1897 - DNA, 20 bp, Artificial Sequence
  Description of Artificial Sequence: Synthetic oligonucleotide
cggttcctctggttcgtccc

SEQ ID NO: 1898 - DNA, 20 bp, Artificial Sequence
  Description of Artificial Sequence: Synthetic oligonucleotide
cgtagtctctgcctgctccc

SEQ ID NO: 1899 - DNA, 20 bp, Artificial Sequence
  Description of Artificial Sequence: Synthetic oligonucleotide
cgtcgtctgtctttcctccc

SEQ ID NO: 1900 - DNA, 20 bp, Artificial Sequence
  Description of Artificial Sequence: Synthetic oligonucleotide
cgtctcgtcttgcccctccc

SEQ ID NO: 1901 - DNA, 20 bp, Artificial Sequence
  Description of Artificial Sequence: Synthetic oligonucleotide
cgtctcgtctttcccctccc

SEQ ID NO: 1902 - DNA, 20 bp, Artificial Sequence
  Description of Artificial Sequence: Synthetic oligonucleotide
cgtctcgttctactgtcccc

SEQ ID NO: 1903 - DNA, 20 bp, Artificial Sequence
  Description of Artificial Sequence: Synthetic oligonucleotide
cgtctcttctggaacctccc

SEQ ID NO: 1904 - DNA, 20 bp, Artificial Sequence
  Description of Artificial Sequence: Synthetic oligonucleotide
cgtgctcgtctgctcctccc

SEQ ID NO: 1905 - DNA, 20 bp, Artificial Sequence
  Description of Artificial Sequence: Synthetic oligonucleotide
cgtgcttctggctactcccc

SEQ ID NO: 1906 - DNA, 20 bp, Artificial Sequence
  Description of Artificial Sequence: Synthetic oligonucleotide
cgtgtcgttctactcctccc

SEQ ID NO: 1907 - DNA, 19 bp, Artificial Sequence
  Description of Artificial Sequence: Synthetic oligonucleotide
cgttcctctggttcgtccc

SEQ ID NO: 1908 - DNA, 20 bp, Artificial Sequence
  Description of Artificial Sequence: Synthetic oligonucleotide
cgttcgtctgttctcgtccc

SEQ ID NO: 1909 - DNA, 20 bp, Artificial Sequence
  Description of Artificial Sequence: Synthetic oligonucleotide
cgttcgttctgttgcctcca

SEQ ID NO: 1910 - DNA, 20 bp, Artificial Sequence
  Description of Artificial Sequence: Synthetic oligonucleotide
cgttcttctggctctcccac

SEQ ID NO: 1911 - DNA, 20 bp, Artificial Sequence
  Description of Artificial Sequence: Synthetic oligonucleotide
cgtttcctatggttcgtccc

SEQ ID NO: 1912 - DNA, 20 bp, Artificial Sequence
  Description of Artificial Sequence: Synthetic oligonucleotide
cgtttcctcaggttcgtccc

SEQ ID NO: 1913 - DNA, 20 bp, Artificial Sequence
  Description of Artificial Sequence: Synthetic oligonucleotide
cgtttcctctggatcgtccc

SEQ ID NO: 1914 - DNA, 19 bp, Artificial Sequence
  Description of Artificial Sequence: Synthetic oligonucleotide
cgtttcctctggtcgtccc

SEQ ID NO: 1915 - DNA, 20 bp, Artificial Sequence
  Description of Artificial Sequence: Synthetic oligonucleotide
cgtttcgtcctggacctccc

SEQ ID NO: 1916 - DNA, 20 bp, Artificial Sequence
  Description of Artificial Sequence: Synthetic oligonucleotide
ctcagtcgttctgcgctccc

SEQ ID NO: 1917 - DNA, 20 bp, Artificial Sequence
  Description of Artificial Sequence: Synthetic oligonucleotide
ctccctattccttccctccc

SEQ ID NO: 1918 - DNA, 20 bp, Artificial Sequence
  Description of Artificial Sequence: Synthetic oligonucleotide
ctcgtctgttcttccctccc

SEQ ID NO: 1919 - DNA, 20 bp, Artificial Sequence
  Description of Artificial Sequence: Synthetic oligonucleotide
ctgagttgttctggcctccc

SEQ ID NO: 1920 - DNA, 20 bp, Artificial Sequence
  Description of Artificial Sequence: Synthetic oligonucleotide
ctggtcgtcttgatcgtccc

SEQ ID NO: 1921 - DNA, 20 bp, Artificial Sequence
  Description of Artificial Sequence: Synthetic oligonucleotide
cttctcgtctgctgtctccc

SEQ ID NO: 1922 - DNA, 20 bp, Artificial Sequence
  Description of Artificial Sequence: Synthetic oligonucleotide
cttctcgtctgtttcctccc

SEQ ID NO: 1923 - DNA, 20 bp, Artificial Sequence
  Description of Artificial Sequence: Synthetic oligonucleotide
cttgtcgatctgctcccccc

SEQ ID NO: 1924 - DNA, 20 bp, Artificial Sequence
  Description of Artificial Sequence: Synthetic oligonucleotide
cttgtcgtctagtccctccc

SEQ ID NO: 1925 - DNA, 20 bp, Artificial Sequence
  Description of Artificial Sequence: Synthetic oligonucleotide
cttgtcgtcttactcgtccc

SEQ ID NO: 1926 - DNA, 20 bp, Artificial Sequence
  Description of Artificial Sequence: Synthetic oligonucleotide
cttgtggtctgttacctccc

SEQ ID NO: 1927 - DNA, 20 bp, Artificial Sequence
  Description of Artificial Sequence: Synthetic oligonucleotide
cttttcgtctgtttcgtctg

SEQ ID NO: 1928 - DNA, 20 bp, Artificial Sequence
  Description of Artificial Sequence: Synthetic oligonucleotide
gacagcgcctgcagtacatt

SEQ ID NO: 1929 - DNA, 20 bp, Artificial Sequence
  Description of Artificial Sequence: Synthetic oligonucleotide
gactcgtctgatcacctccc

SEQ ID NO: 1930 - DNA, 18 bp, Artificial Sequence
  Description of Artificial Sequence: Synthetic oligonucleotide
gacttatggggctctgtg

SEQ ID NO: 1931 - DNA, 19 bp, Artificial Sequence
  Description of Artificial Sequence: Synthetic oligonucleotide
gattgtatggggctctgtg

SEQ ID NO: 1932 - DNA, 20 bp, Artificial Sequence
  Description of Artificial Sequence: Synthetic oligonucleotide
gcagtttcgtcacacctccc

SEQ ID NO: 1933 - DNA, 20 bp, Artificial Sequence
  Description of Artificial Sequence: Synthetic oligonucleotide
gccactcgtttgttcgtccc

SEQ ID NO: 1934 - DNA, 19 bp, Artificial Sequence
  Description of Artificial Sequence: Synthetic oligonucleotide
gccagcgttctgtactccc

SEQ ID NO: 1935 - DNA, 20 bp, Artificial Sequence
  Description of Artificial Sequence: Synthetic oligonucleotide
gccattcgtctcttcgtccc

SEQ ID NO: 1936 - DNA, 19 bp, Artificial Sequence
  Description of Artificial Sequence: Synthetic oligonucleotide
gccattcgtctttcgtccc

SEQ ID NO: 1937 - DNA, 20 bp, Artificial Sequence
  Description of Artificial Sequence: Synthetic oligonucleotide
gcccagtcgttcttcgtccc

SEQ ID NO: 1938 - DNA, 20 bp, Artificial Sequence
  Description of Artificial Sequence: Synthetic oligonucleotide
gcccggtcgttctttgtccc

SEQ ID NO: 1939 - DNA, 20 bp, Artificial Sequence
  Description of Artificial Sequence: Synthetic oligonucleotide
gcccgtcctttttccctccc

SEQ ID NO: 1940 - DNA, 20 bp, Artificial Sequence
  Description of Artificial Sequence: Synthetic oligonucleotide
gccctcgtctgacttctccc

SEQ ID NO: 1941 - DNA, 20 bp, Artificial Sequence
  Description of Artificial Sequence: Synthetic oligonucleotide
gccctcttctggttcgtccc

SEQ ID NO: 1942 - DNA, 21 bp, Artificial Sequence
  Description of Artificial Sequence: Synthetic oligonucleotide
gccctgtcgtctgttcgcccc

SEQ ID NO: 1943 - DNA, 20 bp, Artificial Sequence
  Description of Artificial Sequence: Synthetic oligonucleotide
gcccttcgtctattcctccc

SEQ ID NO: 1944 - DNA, 20 bp, Artificial Sequence
  Description of Artificial Sequence: Synthetic oligonucleotide
gcctatcgtctttacgtccc

SEQ ID NO: 1945 - DNA, 20 bp, Artificial Sequence
  Description of Artificial Sequence: Synthetic oligonucleotide
gcctcagtcgtttcactccc

SEQ ID NO: 1946 - DNA, 20 bp, Artificial Sequence
  Description of Artificial Sequence: Synthetic oligonucleotide
gcctcgtctgtattggccgc

SEQ ID NO: 1947 - DNA, 17 bp, Artificial Sequence
  Description of Artificial Sequence: Synthetic oligonucleotide
gcctcgtctgttgtccc

SEQ ID NO: 1948 - DNA, 20 bp, Artificial Sequence
  Description of Artificial Sequence: Synthetic oligonucleotide
gcctcgtcttttgtgtcccc

SEQ ID NO: 1949 - DNA, 20 bp, Artificial Sequence
  Description of Artificial Sequence: Synthetic oligonucleotide
gcctctcgtctactactccc

SEQ ID NO: 1950 - DNA, 20 bp, Artificial Sequence
  Description of Artificial Sequence: Synthetic oligonucleotide
gcctctcgtctgttcccccc

SEQ ID NO: 1951 - DNA, 19 bp, Artificial Sequence
  Description of Artificial Sequence: Synthetic oligonucleotide
gcctctcgtctgttgtccc

SEQ ID NO: 1952 - DNA, 20 bp, Artificial Sequence
  Description of Artificial Sequence: Synthetic oligonucleotide
gcctctcgtcttgcgctccc

SEQ ID NO: 1953 - DNA, 20 bp, Artificial Sequence
  Description of Artificial Sequence: Synthetic oligonucleotide
gcctctgtcgtgcttctccc

SEQ ID NO: 1954 - DNA, 20 bp, Artificial Sequence
  Description of Artificial Sequence: Synthetic oligonucleotide
gcctgcttcgtctgtctccc

SEQ ID NO: 1955 - DNA, 20 bp, Artificial Sequence
  Description of Artificial Sequence: Synthetic oligonucleotide
gcctgtacgtctctcctccc

SEQ ID NO: 1956 - DNA, 20 bp, Artificial Sequence
  Description of Artificial Sequence: Synthetic oligonucleotide
gcctgtcctctgaagctccc

SEQ ID NO: 1957 - DNA, 20 bp, Artificial Sequence
  Description of Artificial Sequence: Synthetic oligonucleotide
gcctgttctctgctcttccc

SEQ ID NO: 1958 - DNA, 20 bp, Artificial Sequence
  Description of Artificial Sequence: Synthetic oligonucleotide
gcctgtttcgtctttgtcct

SEQ ID NO: 1959 - DNA, 20 bp, Artificial Sequence
  Description of Artificial Sequence: Synthetic oligonucleotide
gccttcgtctagagcctccc

SEQ ID NO: 1960 - DNA, 20 bp, Artificial Sequence
  Description of Artificial Sequence: Synthetic oligonucleotide
gccttcgtctatttcgtccc

SEQ ID NO: 1961 - DNA, 19 bp, Artificial Sequence
  Description of Artificial Sequence: Synthetic oligonucleotide
gccttctcgtctgtgtccc

SEQ ID NO: 1962 - DNA, 20 bp, Artificial Sequence
  Description of Artificial Sequence: Synthetic oligonucleotide
gccttctcgtctgttgcccc

SEQ ID NO: 1963 - DNA, 22 bp, Artificial Sequence
  Description of Artificial Sequence: Synthetic oligonucleotide
gccttctcgtctgttgcccccc

SEQ ID NO: 1964 - DNA, 20 bp, Artificial Sequence
  Description of Artificial Sequence: Synthetic oligonucleotide
gccttctcgtctgttgtacc

SEQ ID NO: 1965 - DNA, 20 bp, Artificial Sequence
  Description of Artificial Sequence: Synthetic oligonucleotide
gccttctcgtcttgcctccc

SEQ ID NO: 1966 - DNA, 18 bp, Artificial Sequence
  Description of Artificial Sequence: Synthetic oligonucleotide
gccttctcgtcttgtccc

SEQ ID NO: 1967 - DNA, 20 bp, Artificial Sequence
  Description of Artificial Sequence: Synthetic oligonucleotide
gccttctcgtcttttgtccc

SEQ ID NO: 1968 - DNA, 20 bp, Artificial Sequence
  Description of Artificial Sequence: Synthetic oligonucleotide
gcctttcgtcatggcctccc

SEQ ID NO: 1969 - DNA, 20 bp, Artificial Sequence
  Description of Artificial Sequence: Synthetic oligonucleotide
gcctttcgtcctgacctccc

SEQ ID NO: 1970 - DNA, 20 bp, Artificial Sequence
  Description of Artificial Sequence: Synthetic oligonucleotide
gcctttcgtctgcttctccc

SEQ ID NO: 1971 - DNA, 20 bp, Artificial Sequence
  Description of Artificial Sequence: Synthetic oligonucleotide
gcctttcgttctgacctacc

SEQ ID NO: 1972 - DNA, 20 bp, Artificial Sequence
  Description of Artificial Sequence: Synthetic oligonucleotide
gcctttcgtttgtttgtccc

SEQ ID NO: 1973 - DNA, 20 bp, Artificial Sequence
  Description of Artificial Sequence: Synthetic oligonucleotide
gcctttcgttttgacctccc

SEQ ID NO: 1974 - DNA, 22 bp, Artificial Sequence
  Description of Artificial Sequence: Synthetic oligonucleotide
gccttttcgtctgttgtccccc

SEQ ID NO: 1975 - DNA, 21 bp, Artificial Sequence
  Description of Artificial Sequence: Synthetic oligonucleotide
gccttttcgttctgacctccc

SEQ ID NO: 1976 - DNA, 20 bp, Artificial Sequence
  Description of Artificial Sequence: Synthetic oligonucleotide
gccttttgttctgacctccc

SEQ ID NO: 1977 - DNA, 20 bp, Artificial Sequence
  Description of Artificial Sequence: Synthetic oligonucleotide
gcgacgctctgtctcttccc

SEQ ID NO: 1978 - DNA, 20 bp, Artificial Sequence
  Description of Artificial Sequence: Synthetic oligonucleotide
gcgattcctctgtccctccc

SEQ ID NO: 1979 - DNA, 20 bp, Artificial Sequence
  Description of Artificial Sequence: Synthetic oligonucleotide
gcgctcctctgcttcttccc

SEQ ID NO: 1980 - DNA, 20 bp, Artificial Sequence
  Description of Artificial Sequence: Synthetic oligonucleotide
gcggctctctgtttcgtccc

SEQ ID NO: 1981 - DNA, 20 bp, Artificial Sequence
  Description of Artificial Sequence: Synthetic oligonucleotide
gcggttttggggggactgtg

SEQ ID NO: 1982 - DNA, 20 bp, Artificial Sequence
  Description of Artificial Sequence: Synthetic oligonucleotide
gcgtatcctctgcaactccc

SEQ ID NO: 1983 - DNA, 20 bp, Artificial Sequence
  Description of Artificial Sequence: Synthetic oligonucleotide
gcgtctcgttttccactccc

SEQ ID NO: 1984 - DNA, 20 bp, Artificial Sequence
  Description of Artificial Sequence: Synthetic oligonucleotide
gcgtcttacgtctttgtccc

SEQ ID NO: 1985 - DNA, 20 bp, Artificial Sequence
  Description of Artificial Sequence: Synthetic oligonucleotide
gcgttatcgtctcacgtccc

SEQ ID NO: 1986 - DNA, 20 bp, Artificial Sequence
  Description of Artificial Sequence: Synthetic oligonucleotide
gcgttcgctgtttccatccc

SEQ ID NO: 1987 - DNA, 21 bp, Artificial Sequence
  Description of Artificial Sequence: Synthetic oligonucleotide
gcgttctcgtcgattgtcccc

SEQ ID NO: 1988 - DNA, 20 bp, Artificial Sequence
  Description of Artificial Sequence: Synthetic oligonucleotide
gcgtttactctgttcgtccc

SEQ ID NO: 1989 - DNA, 17 bp, Artificial Sequence
  Description of Artificial Sequence: Synthetic oligonucleotide
gcgtttcctctgttccc

SEQ ID NO: 1990 - DNA, 20 bp, Artificial Sequence
  Description of Artificial Sequence: Synthetic oligonucleotide
gcgtttcctctgttcgtacc

SEQ ID NO: 1991 - DNA, 20 bp, Artificial Sequence
  Description of Artificial Sequence: Synthetic oligonucleotide
gcgtttcctctgttcgtcac

SEQ ID NO: 1992 - DNA, 20 bp, Artificial Sequence
  Description of Artificial Sequence: Synthetic oligonucleotide
gcgtttcctctgttcgtcca

SEQ ID NO: 1993 - DNA, 20 bp, Artificial Sequence
  Description of Artificial Sequence: Synthetic oligonucleotide
gcgtttcctttgttcgtccc

SEQ ID NO: 1994 - DNA, 20 bp, Artificial Sequence
  Description of Artificial Sequence: Synthetic oligonucleotide
gcgtttcgttttctcgtccc

SEQ ID NO: 1995 - DNA, 19 bp, Artificial Sequence
  Description of Artificial Sequence: Synthetic oligonucleotide
gcgtttctctgttcgtccc

SEQ ID NO: 1996 - DNA, 17 bp, Artificial Sequence
  Description of Artificial Sequence: Synthetic oligonucleotide
gcgtttctgttcgtccc

SEQ ID NO: 1997 - DNA, 20 bp, Artificial Sequence
  Description of Artificial Sequence: Synthetic oligonucleotide
gctattcgttcttgcgtccc

SEQ ID NO: 1998 - DNA, 20 bp, Artificial Sequence
  Description of Artificial Sequence: Synthetic oligonucleotide
gctattgcgtctgttgtccc

SEQ ID NO: 1999 - DNA, 20 bp, Artificial Sequence
  Description of Artificial Sequence: Synthetic oligonucleotide
gctcctgtcgtcattctccc

SEQ ID NO: 2000 - DNA, 20 bp, Artificial Sequence
  Description of Artificial Sequence: Synthetic oligonucleotide
gctcgtcgttttatcgtccc

SEQ ID NO: 2001 - DNA, 20 bp, Artificial Sequence
  Description of Artificial Sequence: Synthetic oligonucleotide
gctgtagtctctgcgctccc

SEQ ID NO: 2002 - DNA, 20 bp, Artificial Sequence
  Description of Artificial Sequence: Synthetic oligonucleotide
gcttgtctcctgttcgtccc

SEQ ID NO: 2003 - DNA, 20 bp, Artificial Sequence
  Description of Artificial Sequence: Synthetic oligonucleotide
gcttgttctctgttcgtccc

SEQ ID NO: 2004 - DNA, 20 bp, Artificial Sequence
  Description of Artificial Sequence: Synthetic oligonucleotide
gcttgttttctgttcgtccc

SEQ ID NO: 2005 - DNA, 20 bp, Artificial Sequence
  Description of Artificial Sequence: Synthetic oligonucleotide
gctttcctctgtaccctccc

SEQ ID NO: 2006 - DNA, 20 bp, Artificial Sequence
  Description of Artificial Sequence: Synthetic oligonucleotide
gcttttcgactgacgctccc

SEQ ID NO: 2007 - DNA, 20 bp, Artificial Sequence
  Description of Artificial Sequence: Synthetic oligonucleotide
gcttttcgtctttgcgtccc

SEQ ID NO: 2008 - DNA, 17 bp, Artificial Sequence
  Description of Artificial Sequence: Synthetic oligonucleotide
ggggttttcccgtgccc

SEQ ID NO: 2009 - DNA, 20 bp, Artificial Sequence
  Description of Artificial Sequence: Synthetic oligonucleotide
ggtagttcgtctgcgctccc

SEQ ID NO: 2010 - DNA, 20 bp, Artificial Sequence
  Description of Artificial Sequence: Synthetic oligonucleotide
gtagatcgtcttaccctccc

SEQ ID NO: 2011 - DNA, 20 bp, Artificial Sequence
  Description of Artificial Sequence: Synthetic oligonucleotide
gtagattcgtctcgcgtccc

SEQ ID NO: 2012 - DNA, 20 bp, Artificial Sequence
  Description of Artificial Sequence: Synthetic oligonucleotide
gtagtcgtcctgttggccgc

SEQ ID NO: 2013 - DNA, 20 bp, Artificial Sequence
  Description of Artificial Sequence: Synthetic oligonucleotide
gtatagtctctgatgctccc

SEQ ID NO: 2014 - DNA, 20 bp, Artificial Sequence
  Description of Artificial Sequence: Synthetic oligonucleotide
gtatcctcgtctgtggccgc

SEQ ID NO: 2015 - DNA, 20 bp, Artificial Sequence
  Description of Artificial Sequence: Synthetic oligonucleotide
gtcactcgtctgcacctccc

SEQ ID NO: 2016 - DNA, 21 bp, Artificial Sequence
  Description of Artificial Sequence: Synthetic oligonucleotide
gtccagtcgtctgttcgtccc

SEQ ID NO: 2017 - DNA, 20 bp, Artificial Sequence
  Description of Artificial Sequence: Synthetic oligonucleotide
gtccgagcttctgtggccgc

SEQ ID NO: 2018 - DNA, 21 bp, Artificial Sequence
  Description of Artificial Sequence: Synthetic oligonucleotide
gtcctggcgtctgttcgtccc

SEQ ID NO: 2019 - DNA, 20 bp, Artificial Sequence
  Description of Artificial Sequence: Synthetic oligonucleotide
gtcctgtcgtctgctgtccc

SEQ ID NO: 2020 - DNA, 21 bp, Artificial Sequence
  Description of Artificial Sequence: Synthetic oligonucleotide
gtcctgtcgtctgttagaccc

SEQ ID NO: 2021 - DNA, 21 bp, Artificial Sequence
  Description of Artificial Sequence: Synthetic oligonucleotide
gtcctgtcgtctgttcggttc

SEQ ID NO: 2022 - DNA, 19 bp, Artificial Sequence
  Description of Artificial Sequence: Synthetic oligonucleotide
gtcctgtcgtctgttcgtc

SEQ ID NO: 2023 - DNA, 21 bp, Artificial Sequence
  Description of Artificial Sequence: Synthetic oligonucleotide
gtcctgtcgtctgttcgtcaa

SEQ ID NO: 2024 - DNA, 20 bp, Artificial Sequence
  Description of Artificial Sequence: Synthetic oligonucleotide
gtcctgtcgtctgttctccc

SEQ ID NO: 2025 - DNA, 20 bp, Artificial Sequence
  Description of Artificial Sequence: Synthetic oligonucleotide
gtccttcgtctgttcgtccc

SEQ ID NO: 2026 - DNA, 20 bp, Artificial Sequence
  Description of Artificial Sequence: Synthetic oligonucleotide
gtcctttctggttcctgccc

SEQ ID NO: 2027 - DNA, 20 bp, Artificial Sequence
  Description of Artificial Sequence: Synthetic oligonucleotide
gtcgtctctcagtccgtccc

SEQ ID NO: 2028 - DNA, 20 bp, Artificial Sequence
  Description of Artificial Sequence: Synthetic oligonucleotide
gtcgttggtaagctcctccc

SEQ ID NO: 2029 - DNA, 20 bp, Artificial Sequence
  Description of Artificial Sequence: Synthetic oligonucleotide
gtcgtttgatgcctcctccc

SEQ ID NO: 2030 - DNA, 20 bp, Artificial Sequence
  Description of Artificial Sequence: Synthetic oligonucleotide
gtctcgttcttttccctccc

SEQ ID NO: 2031 - DNA, 20 bp, Artificial Sequence
  Description of Artificial Sequence: Synthetic oligonucleotide
gtgaatcgtttgatcctccc

SEQ ID NO: 2032 - DNA, 20 bp, Artificial Sequence
  Description of Artificial Sequence: Synthetic oligonucleotide
gtgactcgtcctatcctccc

SEQ ID NO: 2033 - DNA, 20 bp, Artificial Sequence
  Description of Artificial Sequence: Synthetic oligonucleotide
gtgagcctctgtagcgtccc

SEQ ID NO: 2034 - DNA, 20 bp, Artificial Sequence
  Description of Artificial Sequence: Synthetic oligonucleotide
gtgattcgcctgtcactccc

SEQ ID NO: 2035 - DNA, 20 bp, Artificial Sequence
  Description of Artificial Sequence: Synthetic oligonucleotide
gtgattcgcctgttcttccc

SEQ ID NO: 2036 - DNA, 20 bp, Artificial Sequence
  Description of Artificial Sequence: Synthetic oligonucleotide
gtgcgttggtctgacctccc

SEQ ID NO: 2037 - DNA, 20 bp, Artificial Sequence
  Description of Artificial Sequence: Synthetic oligonucleotide
gtgctctcgtctacactccc

SEQ ID NO: 2038 - DNA, 20 bp, Artificial Sequence
  Description of Artificial Sequence: Synthetic oligonucleotide
gtgcttcgtttgttcttccc

SEQ ID NO: 2039 - DNA, 20 bp, Artificial Sequence
  Description of Artificial Sequence: Synthetic oligonucleotide
gtgtagtcgttcctcgtccc

SEQ ID NO: 2040 - DNA, 21 bp, Artificial Sequence
  Description of Artificial Sequence: Synthetic oligonucleotide
gtgtccctcgtctgttgccgc

SEQ ID NO: 2041 - DNA, 20 bp, Artificial Sequence
  Description of Artificial Sequence: Synthetic oligonucleotide
gtgtcgttctgatgggccgc

SEQ ID NO: 2042 - DNA, 20 bp, Artificial Sequence
  Description of Artificial Sequence: Synthetic oligonucleotide
gtgtcgttctgttgtgccgc

SEQ ID NO: 2043 - DNA, 20 bp, Artificial Sequence
  Description of Artificial Sequence: Synthetic oligonucleotide
gtgttgttcgtcgccgcctc

SEQ ID NO: 2044 - DNA, 20 bp, Artificial Sequence
  Description of Artificial Sequence: Synthetic oligonucleotide
gtgtttcctctgttcgtccc

SEQ ID NO: 2045 - DNA, 20 bp, Artificial Sequence
  Description of Artificial Sequence: Synthetic oligonucleotide
gttagtcttctgtccctccc

SEQ ID NO: 2046 - DNA, 19 bp, Artificial Sequence
  Description of Artificial Sequence: Synthetic oligonucleotide
gttgtcgtctgttcgtccc

SEQ ID NO: 2047 - DNA, 20 bp, Artificial Sequence
  Description of Artificial Sequence: Synthetic oligonucleotide
taagtcgttcccttcgtccc

SEQ ID NO: 2048 - DNA, 20 bp, Artificial Sequence
  Description of Artificial Sequence: Synthetic oligonucleotide
taatgtcgtatgttagtccc

SEQ ID NO: 2049 - DNA, 20 bp, Artificial Sequence
  Description of Artificial Sequence: Synthetic oligonucleotide
tactggcttgtcgttgtccc

SEQ ID NO: 2050 - DNA, 20 bp, Artificial Sequence
  Description of Artificial Sequence: Synthetic oligonucleotide
tactgtagtctgttagtccc

SEQ ID NO: 2051 - DNA, 20 bp, Artificial Sequence
  Description of Artificial Sequence: Synthetic oligonucleotide
tactgtcgtttgttcgtccc

SEQ ID NO: 2052 - DNA, 20 bp, Artificial Sequence
  Description of Artificial Sequence: Synthetic oligonucleotide
tcaagtcgtctgttcgtccc

SEQ ID NO: 2053 - DNA, 20 bp, Artificial Sequence
  Description of Artificial Sequence: Synthetic oligonucleotide
tcagttcgtctgattctccc

SEQ ID NO: 2054 - DNA, 20 bp, Artificial Sequence
  Description of Artificial Sequence: Synthetic oligonucleotide
tcagttgtctgtggtgccgc

SEQ ID NO: 2055 - DNA, 20 bp, Artificial Sequence
  Description of Artificial Sequence: Synthetic oligonucleotide
tcatgtcatctgttcgtccc

SEQ ID NO: 2056 - DNA, 20 bp, Artificial Sequence
  Description of Artificial Sequence: Synthetic oligonucleotide
tcatgtcgtatgttagtcac

SEQ ID NO: 2057 - DNA, 20 bp, Artificial Sequence
  Description of Artificial Sequence: Synthetic oligonucleotide
tcatgtcgtctgtacgtccc

SEQ ID NO: 2058 - DNA, 20 bp, Artificial Sequence
  Description of Artificial Sequence: Synthetic oligonucleotide
tcatgtcgtctgttagtcca

SEQ ID NO: 2059 - DNA, 19 bp, Artificial Sequence
  Description of Artificial Sequence: Synthetic oligonucleotide
tcatgtcgtctgttcgtcc

SEQ ID NO: 2060 - DNA, 20 bp, Artificial Sequence
  Description of Artificial Sequence: Synthetic oligonucleotide
tcatgtcgtctgttcgtcct

SEQ ID NO: 2061 - DNA, 20 bp, Artificial Sequence
  Description of Artificial Sequence: Synthetic oligonucleotide
tcatgtcgtctgtttgtcca

SEQ ID NO: 2062 - DNA, 20 bp, Artificial Sequence
  Description of Artificial Sequence: Synthetic oligonucleotide
tccaatcgtctgttcgtccc

SEQ ID NO: 2063 - DNA, 20 bp, Artificial Sequence
  Description of Artificial Sequence: Synthetic oligonucleotide
tccacgtggctgcgttggtc

SEQ ID NO: 2064 - DNA, 20 bp, Artificial Sequence
  Description of Artificial Sequence: Synthetic oligonucleotide
tccagtcgtatgttcgtccc

SEQ ID NO: 2065 - DNA, 20 bp, Artificial Sequence
  Description of Artificial Sequence: Synthetic oligonucleotide
tccagtcgtctatgcgtccc

SEQ ID NO: 2066 - DNA, 20 bp, Artificial Sequence
  Description of Artificial Sequence: Synthetic oligonucleotide
tccagtcgtctgatcgtacc

SEQ ID NO: 2067 - DNA, 20 bp, Artificial Sequence
  Description of Artificial Sequence: Synthetic oligonucleotide
tccagtcgtctgctcgtccc

SEQ ID NO: 2068 - DNA, 20 bp, Artificial Sequence
  Description of Artificial Sequence: Synthetic oligonucleotide
tccagtcgtctgttcatccc

SEQ ID NO: 2069 - DNA, 20 bp, Artificial Sequence
  Description of Artificial Sequence: Synthetic oligonucleotide
tccagtcgtctgttcgaccc

SEQ ID NO: 2070 - DNA, 20 bp, Artificial Sequence
  Description of Artificial Sequence: Synthetic oligonucleotide
tccagtcgtctgttcgcccc

SEQ ID NO: 2071 - DNA, 20 bp, Artificial Sequence
  Description of Artificial Sequence: Synthetic oligonucleotide
tccagtcgtctgttcgtttc

SEQ ID NO: 2072 - DNA, 20 bp, Artificial Sequence
  Description of Artificial Sequence: Synthetic oligonucleotide
tccagtcgtctgtttgtccc

SEQ ID NO: 2073 - DNA, 20 bp, Artificial Sequence
  Description of Artificial Sequence: Synthetic oligonucleotide
tccagtcgttctgttggcgc

SEQ ID NO: 2074 - DNA, 21 bp, Artificial Sequence
  Description of Artificial Sequence: Synthetic oligonucleotide
tccatgtcgtctgttcgtccc

SEQ ID NO: 2075 - DNA, 20 bp, Artificial Sequence
  Description of Artificial Sequence: Synthetic oligonucleotide
tcccgtcctctgttcgtccc

SEQ ID NO: 2076 - DNA, 20 bp, Artificial Sequence
  Description of Artificial Sequence: Synthetic oligonucleotide
tcccgtcgtcagttcgtccc

SEQ ID NO: 2077 - DNA, 20 bp, Artificial Sequence
  Description of Artificial Sequence: Synthetic oligonucleotide
tcccgtcgtctattcgtccc

SEQ ID NO: 2078 - DNA, 20 bp, Artificial Sequence
  Description of Artificial Sequence: Synthetic oligonucleotide
tcccgtcgtctgttagtccc

SEQ ID NO: 2079 - DNA, 19 bp, Artificial Sequence
  Description of Artificial Sequence: Synthetic oligonucleotide
tcccgtcgtctgttgtccc

SEQ ID NO: 2080 - DNA, 20 bp, Artificial Sequence
  Description of Artificial Sequence: Synthetic oligonucleotide
tcctatcatctgttcgtccc

SEQ ID NO: 2081 - DNA, 20 bp, Artificial Sequence
  Description of Artificial Sequence: Synthetic oligonucleotide
tcctatcgtctgatcgtccc

SEQ ID NO: 2082 - DNA, 20 bp, Artificial Sequence
  Description of Artificial Sequence: Synthetic oligonucleotide
tcctatcgtctgttagtccc

SEQ ID NO: 2083 - DNA, 20 bp, Artificial Sequence
  Description of Artificial Sequence: Synthetic oligonucleotide
tcctatcgtctgttcgtcac

SEQ ID NO: 2084 - DNA, 20 bp, Artificial Sequence
  Description of Artificial Sequence: Synthetic oligonucleotide
tcctatcgtctgttcgtttc

SEQ ID NO: 2085 - DNA, 20 bp, Artificial Sequence
  Description of Artificial Sequence: Synthetic oligonucleotide
tcctatcgtttgttcgtccc

SEQ ID NO: 2086 - DNA, 20 bp, Artificial Sequence
  Description of Artificial Sequence: Synthetic oligonucleotide
tcctcccgtctgttcgtccc

SEQ ID NO: 2087 - DNA, 20 bp, Artificial Sequence
  Description of Artificial Sequence: Synthetic oligonucleotide
tcctctcgtctgttcgtcct

SEQ ID NO: 2088 - DNA, 20 bp, Artificial Sequence
  Description of Artificial Sequence: Synthetic oligonucleotide
tcctctcgtctgttcgttcc

SEQ ID NO: 2089 - DNA, 20 bp, Artificial Sequence
  Description of Artificial Sequence: Synthetic oligonucleotide
tcctctcttctgttcgtccc

SEQ ID NO: 2090 - DNA, 20 bp, Artificial Sequence
  Description of Artificial Sequence: Synthetic oligonucleotide
tcctgacgtctgttagtccc

SEQ ID NO: 2091 - DNA, 20 bp, Artificial Sequence
  Description of Artificial Sequence: Synthetic oligonucleotide
tcctgacgtctgttcgtcac

SEQ ID NO: 2092 - DNA, 20 bp, Artificial Sequence
  Description of Artificial Sequence: Synthetic oligonucleotide
tcctgccgtatgttcgtccc

SEQ ID NO: 2093 - DNA, 20 bp, Artificial Sequence
  Description of Artificial Sequence: Synthetic oligonucleotide
tcctgccgtctcttcgtccc

SEQ ID NO: 2094 - DNA, 20 bp, Artificial Sequence
  Description of Artificial Sequence: Synthetic oligonucleotide
tcctgccgtctgttcatccc

SEQ ID NO: 2095 - DNA, 20 bp, Artificial Sequence
  Description of Artificial Sequence: Synthetic oligonucleotide
tcctgccttctgttcgtccc

SEQ ID NO: 2096 - DNA, 20 bp, Artificial Sequence
  Description of Artificial Sequence: Synthetic oligonucleotide
tcctggcgcctgttcgtccc

SEQ ID NO: 2097 - DNA, 20 bp, Artificial Sequence
  Description of Artificial Sequence: Synthetic oligonucleotide
tcctggcttggcgttgtccc

SEQ ID NO: 2098 - DNA, 20 bp, Artificial Sequence
  Description of Artificial Sequence: Synthetic oligonucleotide
tcctggcttgtcgtagtccc

SEQ ID NO: 2099 - DNA, 21 bp, Artificial Sequence
  Description of Artificial Sequence: Synthetic oligonucleotide
tcctggcttgtcgttgttccc

SEQ ID NO: 2100 - DNA, 20 bp, Artificial Sequence
  Description of Artificial Sequence: Synthetic oligonucleotide
tcctgtagtatgttcgtaca

SEQ ID NO: 2101 - DNA, 20 bp, Artificial Sequence
  Description of Artificial Sequence: Synthetic oligonucleotide
tcctgtagtctgttagtaac

SEQ ID NO: 2102 - DNA, 20 bp, Artificial Sequence
  Description of Artificial Sequence: Synthetic oligonucleotide
tcctgtagtctgttagtcaa

SEQ ID NO: 2103 - DNA, 20 bp, Artificial Sequence
  Description of Artificial Sequence: Synthetic oligonucleotide
tcctgtagtctgttagttcc

SEQ ID NO: 2104 - DNA, 20 bp, Artificial Sequence
  Description of Artificial Sequence: Synthetic oligonucleotide
tcctgtagtctgttcgcccc

SEQ ID NO: 2105 - DNA, 20 bp, Artificial Sequence
  Description of Artificial Sequence: Synthetic oligonucleotide
tcctgtagtctgttcgtcct

SEQ ID NO: 2106 - DNA, 20 bp, Artificial Sequence
  Description of Artificial Sequence: Synthetic oligonucleotide
tcctgtagtctgtttgtacc

SEQ ID NO: 2107 - DNA, 20 bp, Artificial Sequence
  Description of Artificial Sequence: Synthetic oligonucleotide
tcctgtagtttgttcgtacc

SEQ ID NO: 2108 - DNA, 20 bp, Artificial Sequence
  Description of Artificial Sequence: Synthetic oligonucleotide
tcctgtagtttgtttgtccc

SEQ ID NO: 2109 - DNA, 20 bp, Artificial Sequence
  Description of Artificial Sequence: Synthetic oligonucleotide
tcctgtcatctattcgtccc

SEQ ID NO: 2110 - DNA, 20 bp, Artificial Sequence
  Description of Artificial Sequence: Synthetic oligonucleotide
tcctgtcatctgttcgtcac

SEQ ID NO: 2111 - DNA, 20 bp, Artificial Sequence
  Description of Artificial Sequence: Synthetic oligonucleotide
tcctgtcctctgttcctccc

SEQ ID NO: 2112 - DNA, 20 bp, Artificial Sequence
  Description of Artificial Sequence: Synthetic oligonucleotide
tcctgtcgactgatcgtccc

SEQ ID NO: 2113 - DNA, 20 bp, Artificial Sequence
  Description of Artificial Sequence: Synthetic oligonucleotide
tcctgtcgactgttcgcccc

SEQ ID NO: 2114 - DNA, 20 bp, Artificial Sequence
  Description of Artificial Sequence: Synthetic oligonucleotide
tcctgtcgcatgttcgtccc

SEQ ID NO: 2115 - DNA, 20 bp, Artificial Sequence
  Description of Artificial Sequence: Synthetic oligonucleotide
tcctgtcgcctattcgtccc

SEQ ID NO: 2116 - DNA, 20 bp, Artificial Sequence
  Description of Artificial Sequence: Synthetic oligonucleotide
tcctgtcgcctcttcgtccc

SEQ ID NO: 2117 - DNA, 20 bp, Artificial Sequence
  Description of Artificial Sequence: Synthetic oligonucleotide
tcctgtcgcctgttcgtcct

SEQ ID NO: 2118 - DNA, 19 bp, Artificial Sequence
  Description of Artificial Sequence: Synthetic oligonucleotide
tcctgtcgctgttcgtccc

SEQ ID NO: 2119 - DNA, 20 bp, Artificial Sequence
  Description of Artificial Sequence: Synthetic oligonucleotide
tcctgtcggctgttcgcccc

SEQ ID NO: 2120 - DNA, 20 bp, Artificial Sequence
  Description of Artificial Sequence: Synthetic oligonucleotide
tcctgtcggctgttcgtcca

SEQ ID NO: 2121 - DNA, 20 bp, Artificial Sequence
  Description of Artificial Sequence: Synthetic oligonucleotide
tcctgtcgtatgctcgtccc

SEQ ID NO: 2122 - DNA, 20 bp, Artificial Sequence
  Description of Artificial Sequence: Synthetic oligonucleotide
tcctgtcgtatgttcatcca

SEQ ID NO: 2123 - DNA, 20 bp, Artificial Sequence
  Description of Artificial Sequence: Synthetic oligonucleotide
tcctgtcgtatgttcatccc

SEQ ID NO: 2124 - DNA, 20 bp, Artificial Sequence
  Description of Artificial Sequence: Synthetic oligonucleotide
tcctgtcgtatgttcgcccc

SEQ ID NO: 2125 - DNA, 20 bp, Artificial Sequence
  Description of Artificial Sequence: Synthetic oligonucleotide
tcctgtcgtatgttcggccc

SEQ ID NO: 2126 - DNA, 20 bp, Artificial Sequence
  Description of Artificial Sequence: Synthetic oligonucleotide
tcctgtcgtatgttcgtcct

SEQ ID NO: 2127 - DNA, 20 bp, Artificial Sequence
  Description of Artificial Sequence: Synthetic oligonucleotide
tcctgtcgtatgttcgtcgc

SEQ ID NO: 2128 - DNA, 20 bp, Artificial Sequence
  Description of Artificial Sequence: Synthetic oligonucleotide
tcctgtcgtatgttcgtgcc

SEQ ID NO: 2129 - DNA, 20 bp, Artificial Sequence
  Description of Artificial Sequence: Synthetic oligonucleotide
tcctgtcgtattttcgtacc

SEQ ID NO: 2130 - DNA, 20 bp, Artificial Sequence
  Description of Artificial Sequence: Synthetic oligonucleotide
tcctgtcgtcagttcgcccc

SEQ ID NO: 2131 - DNA, 20 bp, Artificial Sequence
  Description of Artificial Sequence: Synthetic oligonucleotide
tcctgtcgtcagttcgtcct

SEQ ID NO: 2132 - DNA, 20 bp, Artificial Sequence
  Description of Artificial Sequence: Synthetic oligonucleotide
tcctgtcgtcccttcgtccc

SEQ ID NO: 2133 - DNA, 17 bp, Artificial Sequence
  Description of Artificial Sequence: Synthetic oligonucleotide
tcctgtcgtccgttccc

SEQ ID NO: 2134 - DNA, 20 bp, Artificial Sequence
  Description of Artificial Sequence: Synthetic oligonucleotide
tcctgtcgtccgttcgtcca

SEQ ID NO: 2135 - DNA, 19 bp, Artificial Sequence
  Description of Artificial Sequence: Synthetic oligonucleotide
tcctgtcgtcggtcgtccc

SEQ ID NO: 2136 - DNA, 20 bp, Artificial Sequence
  Description of Artificial Sequence: Synthetic oligonucleotide
tcctgtcgtcggttcggccc

SEQ ID NO: 2137 - DNA, 19 bp, Artificial Sequence
  Description of Artificial Sequence: Synthetic oligonucleotide
tcctgtcgtcgttcgtttc

SEQ ID NO: 2138 - DNA, 20 bp, Artificial Sequence
  Description of Artificial Sequence: Synthetic oligonucleotide
tcctgtcgtctattagtccc

SEQ ID NO: 2139 - DNA, 20 bp, Artificial Sequence
  Description of Artificial Sequence: Synthetic oligonucleotide
tcctgtcgtctattcgtctc

SEQ ID NO: 2140 - DNA, 19 bp, Artificial Sequence
  Description of Artificial Sequence: Synthetic oligonucleotide
tcctgtcgtctattgtccc

SEQ ID NO: 2141 - DNA, 20 bp, Artificial Sequence
  Description of Artificial Sequence: Synthetic oligonucleotide
tcctgtcgtctcttcgtacc

SEQ ID NO: 2142 - DNA, 20 bp, Artificial Sequence
  Description of Artificial Sequence: Synthetic oligonucleotide
tcctgtcgtctcttcgtctc

SEQ ID NO: 2143 - DNA, 19 bp, Artificial Sequence
  Description of Artificial Sequence: Synthetic oligonucleotide
tcctgtcgtctcttgtccc

SEQ ID NO: 2144 - DNA, 20 bp, Artificial Sequence
  Description of Artificial Sequence: Synthetic oligonucleotide
tcctgtcgtctgatagtaca

SEQ ID NO: 2145 - DNA, 20 bp, Artificial Sequence
  Description of Artificial Sequence: Synthetic oligonucleotide
tcctgtcgtctgatagtccc

SEQ ID NO: 2146 - DNA, 20 bp, Artificial Sequence
  Description of Artificial Sequence: Synthetic oligonucleotide
tcctgtcgtctgatcgaacc

SEQ ID NO: 2147 - DNA, 20 bp, Artificial Sequence
  Description of Artificial Sequence: Synthetic oligonucleotide
tcctgtcgtctgatcgtctc

SEQ ID NO: 2148 - DNA, 19 bp, Artificial Sequence
  Description of Artificial Sequence: Synthetic oligonucleotide
tcctgtcgtctgccgtccc

SEQ ID NO: 2149 - DNA, 20 bp, Artificial Sequence
  Description of Artificial Sequence: Synthetic oligonucleotide
tcctgtcgtctgctcgtcca

SEQ ID NO: 2150 - DNA, 20 bp, Artificial Sequence
  Description of Artificial Sequence: Synthetic oligonucleotide
tcctgtcgtctgctcgtcct

SEQ ID NO: 2151 - DNA, 21 bp, Artificial Sequence
  Description of Artificial Sequence: Synthetic oligonucleotide
tcctgtcgtctgtaccctccc

SEQ ID NO: 2152 - DNA, 20 bp, Artificial Sequence
  Description of Artificial Sequence: Synthetic oligonucleotide
tcctgtcgtctgtacgtacc

SEQ ID NO: 2153 - DNA, 20 bp, Artificial Sequence
  Description of Artificial Sequence: Synthetic oligonucleotide
tcctgtcgtctgtacgtcca

SEQ ID NO: 2154 - DNA, 20 bp, Artificial Sequence
  Description of Artificial Sequence: Synthetic oligonucleotide
tcctgtcgtctgtcagtccc

SEQ ID NO: 2155 - DNA, 19 bp, Artificial Sequence
  Description of Artificial Sequence: Synthetic oligonucleotide
tcctgtcgtctgtcatccc

SEQ ID NO: 2156 - DNA, 17 bp, Artificial Sequence
  Description of Artificial Sequence: Synthetic oligonucleotide
tcctgtcgtctgtcccc

SEQ ID NO: 2157 - DNA, 20 bp, Artificial Sequence
  Description of Artificial Sequence: Synthetic oligonucleotide
tcctgtcgtctgtccgtacc

SEQ ID NO: 2158 - DNA, 18 bp, Artificial Sequence
  Description of Artificial Sequence: Synthetic oligonucleotide
tcctgtcgtctgtctccc

SEQ ID NO: 2159 - DNA, 20 bp, Artificial Sequence
  Description of Artificial Sequence: Synthetic oligonucleotide
tcctgtcgtctgttagaccc

SEQ ID NO: 2160 - DNA, 20 bp, Artificial Sequence
  Description of Artificial Sequence: Synthetic oligonucleotide
tcctgtcgtctgttagcccc

SEQ ID NO: 2161 - DNA, 19 bp, Artificial Sequence
  Description of Artificial Sequence: Synthetic oligonucleotide
tcctgtcgtctgttagtcc

SEQ ID NO: 2162 - DNA, 20 bp, Artificial Sequence
  Description of Artificial Sequence: Synthetic oligonucleotide
tcctgtcgtctgttagttac

SEQ ID NO: 2163 - DNA, 20 bp, Artificial Sequence
  Description of Artificial Sequence: Synthetic oligonucleotide
tcctgtcgtctgttattccc

SEQ ID NO: 2164 - DNA, 20 bp, Artificial Sequence
  Description of Artificial Sequence: Synthetic oligonucleotide
tcctgtcgtctgttcacccc

SEQ ID NO: 2165 - DNA, 20 bp, Artificial Sequence
  Description of Artificial Sequence: Synthetic oligonucleotide
tcctgtcgtctgttcatcct

SEQ ID NO: 2166 - DNA, 20 bp, Artificial Sequence
  Description of Artificial Sequence: Synthetic oligonucleotide
tcctgtcgtctgttccgccc

SEQ ID NO: 2167 - DNA, 19 bp, Artificial Sequence
  Description of Artificial Sequence: Synthetic oligonucleotide
tcctgtcgtctgttcctcc

SEQ ID NO: 2168 - DNA, 20 bp, Artificial Sequence
  Description of Artificial Sequence: Synthetic oligonucleotide
tcctgtcgtctgttcgccca

SEQ ID NO: 2169 - DNA, 20 bp, Artificial Sequence
  Description of Artificial Sequence: Synthetic oligonucleotide
tcctgtcgtctgttcggcca

SEQ ID NO: 2170 - DNA, 20 bp, Artificial Sequence
  Description of Artificial Sequence: Synthetic oligonucleotide
tcctgtcgtctgttcgtagc

SEQ ID NO: 2171 - DNA, 21 bp, Artificial Sequence
  Description of Artificial Sequence: Synthetic oligonucleotide
tcctgtcgtctgttcgtcacc

SEQ ID NO: 2172 - DNA, 20 bp, Artificial Sequence
  Description of Artificial Sequence: Synthetic oligonucleotide
tcctgtcgtctgttcgttta

SEQ ID NO: 2173 - DNA, 20 bp, Artificial Sequence
  Description of Artificial Sequence: Synthetic oligonucleotide
tcctgtcgtctgttcttctc

SEQ ID NO: 2174 - DNA, 18 bp, Artificial Sequence
  Description of Artificial Sequence: Synthetic oligonucleotide
tcctgtcgtctgttgttc

SEQ ID NO: 2175 - DNA, 21 bp, Artificial Sequence
  Description of Artificial Sequence: Synthetic oligonucleotide
tcctgtcgtctgtttcctccc

SEQ ID NO: 2176 - DNA, 20 bp, Artificial Sequence
  Description of Artificial Sequence: Synthetic oligonucleotide
tcctgtcgtctgtttcgtcc

SEQ ID NO: 2177 - DNA, 20 bp, Artificial Sequence
  Description of Artificial Sequence: Synthetic oligonucleotide
tcctgtcgtctgtttgtaca

SEQ ID NO: 2178 - DNA, 17 bp, Artificial Sequence
  Description of Artificial Sequence: Synthetic oligonucleotide
tcctgtcgtcttctccc

SEQ ID NO: 2179 - DNA, 20 bp, Artificial Sequence
  Description of Artificial Sequence: Synthetic oligonucleotide
tcctgtcgtctttccgtccc

SEQ ID NO: 2180 - DNA, 20 bp, Artificial Sequence
  Description of Artificial Sequence: Synthetic oligonucleotide
tcctgtcgtcttttcgtcca

SEQ ID NO: 2181 - DNA, 20 bp, Artificial Sequence
  Description of Artificial Sequence: Synthetic oligonucleotide
tcctgtcgtcttttcgtttc

SEQ ID NO: 2182 - DNA, 21 bp, Artificial Sequence
  Description of Artificial Sequence: Synthetic oligonucleotide
tcctgtcgtctttttcgtccc

SEQ ID NO: 2183 - DNA, 20 bp, Artificial Sequence
  Description of Artificial Sequence: Synthetic oligonucleotide
tcctgtcgtgtgttcgtcac

SEQ ID NO: 2184 - DNA, 20 bp, Artificial Sequence
  Description of Artificial Sequence: Synthetic oligonucleotide
tcctgtcgtgtgttcgtctc

SEQ ID NO: 2185 - DNA, 19 bp, Artificial Sequence
  Description of Artificial Sequence: Synthetic oligonucleotide
tcctgtcgtttgttcgtcc

SEQ ID NO: 2186 - DNA, 20 bp, Artificial Sequence
  Description of Artificial Sequence: Synthetic oligonucleotide
tcctgtcgtttgttcgtgcc

SEQ ID NO: 2187 - DNA, 20 bp, Artificial Sequence
  Description of Artificial Sequence: Synthetic oligonucleotide
tcctgtcttctgttcatccc

SEQ ID NO: 2188 - DNA, 20 bp, Artificial Sequence
  Description of Artificial Sequence: Synthetic oligonucleotide
tcctgtcttctgttcgcccc

SEQ ID NO: 2189 - DNA, 20 bp, Artificial Sequence
  Description of Artificial Sequence: Synthetic oligonucleotide
tcctgtcttctgttcttccc

SEQ ID NO: 2190 - DNA, 20 bp, Artificial Sequence
  Description of Artificial Sequence: Synthetic oligonucleotide
tcctgtggtctgctcgtccc

SEQ ID NO: 2191 - DNA, 20 bp, Artificial Sequence
  Description of Artificial Sequence: Synthetic oligonucleotide
tcctgtggtctgttcgtcct

SEQ ID NO: 2192 - DNA, 20 bp, Artificial Sequence
  Description of Artificial Sequence: Synthetic oligonucleotide
tcctgttgtctgtccgtccc

SEQ ID NO: 2193 - DNA, 19 bp, Artificial Sequence
  Description of Artificial Sequence: Synthetic oligonucleotide
tcctgttgtctgtcgtccc

SEQ ID NO: 2194 - DNA, 20 bp, Artificial Sequence
  Description of Artificial Sequence: Synthetic oligonucleotide
tcctgttgtctgttcgcccc

SEQ ID NO: 2195 - DNA, 20 bp, Artificial Sequence
  Description of Artificial Sequence: Synthetic oligonucleotide
tcctgttgtctgttcgtttc

SEQ ID NO: 2196 - DNA, 20 bp, Artificial Sequence
  Description of Artificial Sequence: Synthetic oligonucleotide
tcctgttgtcttttcgtccc

SEQ ID NO: 2197 - DNA, 20 bp, Artificial Sequence
  Description of Artificial Sequence: Synthetic oligonucleotide
tcctgttgtgtgttcgtccc

SEQ ID NO: 2198 - DNA, 21 bp, Artificial Sequence
  Description of Artificial Sequence: Synthetic oligonucleotide
tccttgtcgtctgttcgtccc

SEQ ID NO: 2199 - DNA, 20 bp, Artificial Sequence
  Description of Artificial Sequence: Synthetic oligonucleotide
tcctttcgtatgttagtccc

SEQ ID NO: 2200 - DNA, 20 bp, Artificial Sequence
  Description of Artificial Sequence: Synthetic oligonucleotide
tcctttcgtctgttagtccc

SEQ ID NO: 2201 - DNA, 20 bp, Artificial Sequence
  Description of Artificial Sequence: Synthetic oligonucleotide
tcctttcgtctgttcctccc

SEQ ID NO: 2202 - DNA, 20 bp, Artificial Sequence
  Description of Artificial Sequence: Synthetic oligonucleotide
tcctttcgtctgttcgtcca

SEQ ID NO: 2203 - DNA, 19 bp, Artificial Sequence
  Description of Artificial Sequence: Synthetic oligonucleotide
tcgacgtctgctatctccc

SEQ ID NO: 2204 - DNA, 20 bp, Artificial Sequence
  Description of Artificial Sequence: Synthetic oligonucleotide
tcgacgtctgctatcttccc

SEQ ID NO: 2205 - DNA, 20 bp, Artificial Sequence
  Description of Artificial Sequence: Synthetic oligonucleotide
tcgacttcgtctcacctccc

SEQ ID NO: 2206 - DNA, 20 bp, Artificial Sequence
  Description of Artificial Sequence: Synthetic oligonucleotide
tcgagcgctgtttccctccc

SEQ ID NO: 2207 - DNA, 20 bp, Artificial Sequence
  Description of Artificial Sequence: Synthetic oligonucleotide
tcgagtcgttccctcgtccc

SEQ ID NO: 2208 - DNA, 20 bp, Artificial Sequence
  Description of Artificial Sequence: Synthetic oligonucleotide
tcgagtgtctgatccctccc

SEQ ID NO: 2209 - DNA, 20 bp, Artificial Sequence
  Description of Artificial Sequence: Synthetic oligonucleotide
tcgagttctctgtagctccc

SEQ ID NO: 2210 - DNA, 20 bp, Artificial Sequence
  Description of Artificial Sequence: Synthetic oligonucleotide
tcgattctcgtctgtgccgc

SEQ ID NO: 2211 - DNA, 20 bp, Artificial Sequence
  Description of Artificial Sequence: Synthetic oligonucleotide
tcggagtcgttctacctccc

SEQ ID NO: 2212 - DNA, 20 bp, Artificial Sequence
  Description of Artificial Sequence: Synthetic oligonucleotide
tcggagtcgttttgcctccc

SEQ ID NO: 2213 - DNA, 20 bp, Artificial Sequence
  Description of Artificial Sequence: Synthetic oligonucleotide
tcggctcgtctgcaactccc

SEQ ID NO: 2214 - DNA, 20 bp, Artificial Sequence
  Description of Artificial Sequence: Synthetic oligonucleotide
tcgggtcttctttgcgtccc

SEQ ID NO: 2215 - DNA, 20 bp, Artificial Sequence
  Description of Artificial Sequence: Synthetic oligonucleotide
tcggtcgtctttaacgtccc

SEQ ID NO: 2216 - DNA, 20 bp, Artificial Sequence
  Description of Artificial Sequence: Synthetic oligonucleotide
tcgtctcgtctgcgctcccc

SEQ ID NO: 2217 - DNA, 20 bp, Artificial Sequence
  Description of Artificial Sequence: Synthetic oligonucleotide
tcgtctcgtctgctcctccc

SEQ ID NO: 2218 - DNA, 20 bp, Artificial Sequence
  Description of Artificial Sequence: Synthetic oligonucleotide
tcgtgtcgtctcttcgtccc

SEQ ID NO: 2219 - DNA, 20 bp, Artificial Sequence
  Description of Artificial Sequence: Synthetic oligonucleotide
tcgtgtcttctgttcgtccc

SEQ ID NO: 2220 - DNA, 20 bp, Artificial Sequence
  Description of Artificial Sequence: Synthetic oligonucleotide
tcgttcgtctgctgggccgc

SEQ ID NO: 2221 - DNA, 20 bp, Artificial Sequence
  Description of Artificial Sequence: Synthetic oligonucleotide
tctcagtagtaggcctgctg

SEQ ID NO: 2222 - DNA, 20 bp, Artificial Sequence
  Description of Artificial Sequence: Synthetic oligonucleotide
tctcagtagtgggcttgctg

SEQ ID NO: 2223 - DNA, 20 bp, Artificial Sequence
  Description of Artificial Sequence: Synthetic oligonucleotide
tctcagtggtgggcctgctg

SEQ ID NO: 2224 - DNA, 18 bp, Artificial Sequence
  Description of Artificial Sequence: Synthetic oligonucleotide
tctctgggatttccgccc

SEQ ID NO: 2225 - DNA, 21 bp, Artificial Sequence
  Description of Artificial Sequence: Synthetic oligonucleotide
tctggggtttttcccgtgccc

SEQ ID NO: 2226 - DNA, 20 bp, Artificial Sequence
  Description of Artificial Sequence: Synthetic oligonucleotide
tctggtcgtctgttcgtccc

SEQ ID NO: 2227 - DNA, 19 bp, Artificial Sequence
  Description of Artificial Sequence: Synthetic oligonucleotide
tctgtcgtctgttcggccc

SEQ ID NO: 2228 - DNA, 19 bp, Artificial Sequence
  Description of Artificial Sequence: Synthetic oligonucleotide
tctgtctgggatgtggccc

SEQ ID NO: 2229 - DNA, 17 bp, Artificial Sequence
  Description of Artificial Sequence: Synthetic oligonucleotide
tctgtgggatgtggccc

SEQ ID NO: 2230 - DNA, 20 bp, Artificial Sequence
  Description of Artificial Sequence: Synthetic oligonucleotide
tctgtgggtatcctccgccc

SEQ ID NO: 2231 - DNA, 19 bp, Artificial Sequence
  Description of Artificial Sequence: Synthetic oligonucleotide
tctgtgtgggttgtggccc

SEQ ID NO: 2232 - DNA, 21 bp, Artificial Sequence
  Description of Artificial Sequence: Synthetic oligonucleotide
tctgttgtgtttgatatgccc

SEQ ID NO: 2233 - DNA, 20 bp, Artificial Sequence
  Description of Artificial Sequence: Synthetic oligonucleotide
tcttagtagtgggcctgctg

SEQ ID NO: 2234 - DNA, 20 bp, Artificial Sequence
  Description of Artificial Sequence: Synthetic oligonucleotide
tcttctgggtattcccaccc

SEQ ID NO: 2235 - DNA, 19 bp, Artificial Sequence
  Description of Artificial Sequence: Synthetic oligonucleotide
tcttctgggtttgccgccc

SEQ ID NO: 2236 - DNA, 20 bp, Artificial Sequence
  Description of Artificial Sequence: Synthetic oligonucleotide
tcttctgggttttcctgccc

SEQ ID NO: 2237 - DNA, 20 bp, Artificial Sequence
  Description of Artificial Sequence: Synthetic oligonucleotide
tcttctggtgtgctccccgc

SEQ ID NO: 2238 - DNA, 18 bp, Artificial Sequence
  Description of Artificial Sequence: Synthetic oligonucleotide
tcttgtcgtctgttcccc

SEQ ID NO: 2239 - DNA, 20 bp, Artificial Sequence
  Description of Artificial Sequence: Synthetic oligonucleotide
tcttgtcgtctgttcggccc

SEQ ID NO: 2240 - DNA, 20 bp, Artificial Sequence
  Description of Artificial Sequence: Synthetic oligonucleotide
tcttgtcgtctgttcgtccg

SEQ ID NO: 2241 - DNA, 20 bp, Artificial Sequence
  Description of Artificial Sequence: Synthetic oligonucleotide
tcttgtggtctgttcgtccc

SEQ ID NO: 2242 - DNA, 20 bp, Artificial Sequence
  Description of Artificial Sequence: Synthetic oligonucleotide
tgaactcgttctgcgctccc

SEQ ID NO: 2243 - DNA, 20 bp, Artificial Sequence
  Description of Artificial Sequence: Synthetic oligonucleotide
tgactcgtctgtttcgtctc

SEQ ID NO: 2244 - DNA, 20 bp, Artificial Sequence
  Description of Artificial Sequence: Synthetic oligonucleotide
tgagccttctgttacctccc

SEQ ID NO: 2245 - DNA, 20 bp, Artificial Sequence
  Description of Artificial Sequence: Synthetic oligonucleotide
tgaggtctgtctgtggccgc

SEQ ID NO: 2246 - DNA, 20 bp, Artificial Sequence
  Description of Artificial Sequence: Synthetic oligonucleotide
tgagtcgttccctccgtccc

SEQ ID NO: 2247 - DNA, 20 bp, Artificial Sequence
  Description of Artificial Sequence: Synthetic oligonucleotide
tgagtcgttcccttcgtcct

SEQ ID NO: 2248 - DNA, 20 bp, Artificial Sequence
  Description of Artificial Sequence: Synthetic oligonucleotide
tgagtcgttcccttcgtctc

SEQ ID NO: 2249 - DNA, 20 bp, Artificial Sequence
  Description of Artificial Sequence: Synthetic oligonucleotide
tgagtcgttccctttgtccc

SEQ ID NO: 2250 - DNA, 20 bp, Artificial Sequence
  Description of Artificial Sequence: Synthetic oligonucleotide
tgagttgtctactgggccgc

SEQ ID NO: 2251 - DNA, 20 bp, Artificial Sequence
  Description of Artificial Sequence: Synthetic oligonucleotide
tgatctcgtctgatggccgc

SEQ ID NO: 2252 - DNA, 20 bp, Artificial Sequence
  Description of Artificial Sequence: Synthetic oligonucleotide
tgattgtcgcctgtggccgc

SEQ ID NO: 2253 - DNA, 20 bp, Artificial Sequence
  Description of Artificial Sequence: Synthetic oligonucleotide
tgcatgtcgtctaacctccc

SEQ ID NO: 2254 - DNA, 20 bp, Artificial Sequence
  Description of Artificial Sequence: Synthetic oligonucleotide
tgcccgtcgtcttgcgtcct

SEQ ID NO: 2255 - DNA, 20 bp, Artificial Sequence
  Description of Artificial Sequence: Synthetic oligonucleotide
tgcctcgtctgctacctccc

SEQ ID NO: 2256 - DNA, 20 bp, Artificial Sequence
  Description of Artificial Sequence: Synthetic oligonucleotide
tgccttcgtctgtcgctccc

SEQ ID NO: 2257 - DNA, 20 bp, Artificial Sequence
  Description of Artificial Sequence: Synthetic oligonucleotide
tgcgattcgtccctcctccc

SEQ ID NO: 2258 - DNA, 20 bp, Artificial Sequence
  Description of Artificial Sequence: Synthetic oligonucleotide
tgcgattcgtcgatgtcccc

SEQ ID NO: 2259 - DNA, 20 bp, Artificial Sequence
  Description of Artificial Sequence: Synthetic oligonucleotide
tgcgtgacgtctcacctccc

SEQ ID NO: 2260 - DNA, 20 bp, Artificial Sequence
  Description of Artificial Sequence: Synthetic oligonucleotide
tgcgtgctcgtctacctccc

SEQ ID NO: 2261 - DNA, 20 bp, Artificial Sequence
  Description of Artificial Sequence: Synthetic oligonucleotide
tgcgttcgtcttaccctccc

SEQ ID NO: 2262 - DNA, 20 bp, Artificial Sequence
  Description of Artificial Sequence: Synthetic oligonucleotide
tgctcgttgtctgttgccgc

SEQ ID NO: 2263 - DNA, 20 bp, Artificial Sequence
  Description of Artificial Sequence: Synthetic oligonucleotide
tgctgtcgtctgttagtccc

SEQ ID NO: 2264 - DNA, 19 bp, Artificial Sequence
  Description of Artificial Sequence: Synthetic oligonucleotide
tgctgtcgtctgttctccc

SEQ ID NO: 2265 - DNA, 20 bp, Artificial Sequence
  Description of Artificial Sequence: Synthetic oligonucleotide
tgggtcgtcatatccgtccc

SEQ ID NO: 2266 - DNA, 20 bp, Artificial Sequence
  Description of Artificial Sequence: Synthetic oligonucleotide
tgtcatagtctatccgcccg

SEQ ID NO: 2267 - DNA, 20 bp, Artificial Sequence
  Description of Artificial Sequence: Synthetic oligonucleotide
tgtcctcattcccgcctccc

SEQ ID NO: 2268 - DNA, 20 bp, Artificial Sequence
  Description of Artificial Sequence: Synthetic oligonucleotide
tgtcgggtcgcctttgtccc

SEQ ID NO: 2269 - DNA, 20 bp, Artificial Sequence
  Description of Artificial Sequence: Synthetic oligonucleotide
tgtgttggtctgttccgccc

SEQ ID NO: 2270 - DNA, 20 bp, Artificial Sequence
  Description of Artificial Sequence: Synthetic oligonucleotide
tgttgtagtcgtcgtggccg

SEQ ID NO: 2271 - DNA, 20 bp, Artificial Sequence
  Description of Artificial Sequence: Synthetic oligonucleotide
tgttgtccgtctgcgctccc

SEQ ID NO: 2272 - DNA, 20 bp, Artificial Sequence
  Description of Artificial Sequence: Synthetic oligonucleotide
ttagggggggacgcattgtc

SEQ ID NO: 2273 - DNA, 20 bp, Artificial Sequence
  Description of Artificial Sequence: Synthetic oligonucleotide
ttaggggttttcccgtgccc

SEQ ID NO: 2274 - DNA, 20 bp, Artificial Sequence
  Description of Artificial Sequence: Synthetic oligonucleotide
ttccgtcgtctgttcgtccc

SEQ ID NO: 2275 - DNA, 20 bp, Artificial Sequence
  Description of Artificial Sequence: Synthetic oligonucleotide
ttctgtcgtctgctcgtccc

SEQ ID NO: 2276 - DNA, 20 bp, Artificial Sequence
  Description of Artificial Sequence: Synthetic oligonucleotide
ttctgtcgtctgttcgcccc

SEQ ID NO: 2277 - DNA, 20 bp, Artificial Sequence
  Description of Artificial Sequence: Synthetic oligonucleotide
ttctgtcgtctgttcgtcac

SEQ ID NO: 2278 - DNA, 20 bp, Artificial Sequence
  Description of Artificial Sequence: Synthetic oligonucleotide
ttctgtcgtcttttcgtccc

SEQ ID NO: 2279 - DNA, 20 bp, Artificial Sequence
  Description of Artificial Sequence: Synthetic oligonucleotide
ttcttctgggtttcccgccc

SEQ ID NO: 2280 - DNA, 21 bp, Artificial Sequence
  Description of Artificial Sequence: Synthetic oligonucleotide
ttgctggtcgtctgcactccc

SEQ ID NO: 2281 - DNA, 18 bp, Artificial Sequence
  Description of Artificial Sequence: Synthetic oligonucleotide
ttggcttgtcgttgtccc

SEQ ID NO: 2282 - DNA, 18 bp, Artificial Sequence
  Description of Artificial Sequence: Synthetic oligonucleotide
ttggggtttcccgtgccc

SEQ ID NO: 2283 - DNA, 20 bp, Artificial Sequence
  Description of Artificial Sequence: Synthetic oligonucleotide
ttgtctctgggttgccgccc

SEQ ID NO: 2284 - DNA, 20 bp, Artificial Sequence
  Description of Artificial Sequence: Synthetic oligonucleotide
tttgatcggggcgcatttgc

SEQ ID NO: 2285 - DNA, 20 bp, Artificial Sequence
  Description of Artificial Sequence: Synthetic oligonucleotide
tttggggtattcccccgccc

SEQ ID NO: 2286 - DNA, 18 bp, Artificial Sequence
  Description of Artificial Sequence: Synthetic oligonucleotide
tttggggtttccgtgccc

SEQ ID NO: 2287 - DNA, 20 bp, Artificial Sequence
  Description of Artificial Sequence: Synthetic oligonucleotide
tttggggtttcttcccgccg

SEQ ID NO: 2288 - DNA, 20 bp, Artificial Sequence
  Description of Artificial Sequence: Synthetic oligonucleotide
tttggggttttcccgagacc

SEQ ID NO: 2289 - DNA, 20 bp, Artificial Sequence
  Description of Artificial Sequence: Synthetic oligonucleotide
tttggggttttccggtgccc

SEQ ID NO: 2290 - DNA, 21 bp, Artificial Sequence
  Description of Artificial Sequence: Synthetic oligonucleotide
tttggggtttttcccctgccc

SEQ ID NO: 2291 - DNA, 21 bp, Artificial Sequence
  Description of Artificial Sequence: Synthetic oligonucleotide
tttggggtttttctcgtgccc

SEQ ID NO: 2292 - DNA, 22 bp, Artificial Sequence
  Description of Artificial Sequence: Synthetic oligonucleotide
tttggggttttttcccgtaccc

SEQ ID NO: 2293 - DNA, 22 bp, Artificial Sequence
  Description of Artificial Sequence: Synthetic oligonucleotide
tttggggttttttcccgtgtcc

SEQ ID NO: 2294 - DNA, 21 bp, Artificial Sequence
  Description of Artificial Sequence: Synthetic oligonucleotide
tttgggttttttcccgtgccc

SEQ ID NO: 2295 - DNA, 20 bp, Artificial Sequence
  Description of Artificial Sequence: Synthetic oligonucleotide
actggggttttatcccgccc

SEQ ID NO: 2296 - DNA, 20 bp, Artificial Sequence
  Description of Artificial Sequence: Synthetic oligonucleotide
atgtatgttgggagccacac

SEQ ID NO: 2297 - DNA, 20 bp, Artificial Sequence
  Description of Artificial Sequence: Synthetic oligonucleotide
ccccttcatcttctcccccc

SEQ ID NO: 2298 - DNA, 20 bp, Artificial Sequence
  Description of Artificial Sequence: Synthetic oligonucleotide
ccgcagacctcacacttgtc

SEQ ID NO: 2299 - DNA, 20 bp, Artificial Sequence
  Description of Artificial Sequence: Synthetic oligonucleotide
cgttgtttgtctgtggccgc

SEQ ID NO: 2300 - DNA, 19 bp, Artificial Sequence
  Description of Artificial Sequence: Synthetic oligonucleotide
gactgtatgaggctctgtg

SEQ ID NO: 2301 - DNA, 20 bp, Artificial Sequence
  Description of Artificial Sequence: Synthetic oligonucleotide
tctgggtaattcctccgccc

SEQ ID NO: 2302 - DNA, 19 bp, Artificial Sequence
  Description of Artificial Sequence: Synthetic oligonucleotide
tctgtgtgggatgcggccc

SEQ ID NO: 2303 - DNA, 19 bp, Artificial Sequence
  Description of Artificial Sequence: Synthetic oligonucleotide
tctgtgtgggatgtggcac

SEQ ID NO: 2304 - DNA, 20 bp, Artificial Sequence
  Description of Artificial Sequence: Synthetic oligonucleotide
tctgttgtgcttgatatgcc

SEQ ID NO: 2305 - DNA, 20 bp, Artificial Sequence
  Description of Artificial Sequence: Synthetic oligonucleotide
tcttggggtttctcctgccc

SEQ ID NO: 2306 - DNA, 20 bp, Artificial Sequence
  Description of Artificial Sequence: Synthetic oligonucleotide
tgtgtagctcgtcatgtggc

SEQ ID NO: 2307 - DNA, 20 bp, Artificial Sequence
  Description of Artificial Sequence: Synthetic oligonucleotide
ttcgttctgggttcctgccc

SEQ ID NO: 2308 - DNA, 20 bp, Artificial Sequence
  Description of Artificial Sequence: Synthetic oligonucleotide
ttctgcacttatcccgtgtg

SEQ ID NO: 2309 - DNA, 20 bp, Artificial Sequence
  Description of Artificial Sequence: Synthetic oligonucleotide
tttcgggttttcccgtgccc

SEQ ID NO: 2310 - DNA, 20 bp, Artificial Sequence
  Description of Artificial Sequence: Synthetic oligonucleotide
tttgccacattcccggtgtg

SEQ ID NO: 2311 - DNA, 19 bp, Artificial Sequence
  Description of Artificial Sequence: Synthetic oligonucleotide
tttggggatttcctgcccc

SEQ ID NO: 2312 - DNA, 21 bp, Artificial Sequence
  Description of Artificial Sequence: Synthetic oligonucleotide
tttggggttcttcccgtaccc

SEQ ID NO: 2313 - DNA, 20 bp, Artificial Sequence
  Description of Artificial Sequence: Synthetic oligonucleotide
tttggggtttcttccccccc

SEQ ID NO: 2314 - DNA, 19 bp, Artificial Sequence
  Description of Artificial Sequence: Synthetic oligonucleotide
tttggggtttcttcccgcc

SEQ ID NO: 2315 - DNA, 20 bp, Artificial Sequence
  Description of Artificial Sequence: Synthetic oligonucleotide
tttggggtttcttctcgccc

SEQ ID NO: 2316 - DNA, 20 bp, Artificial Sequence
  Description of Artificial Sequence: Synthetic oligonucleotide
tttggggttttcccgtgcgc

SEQ ID NO: 2317 - DNA, 20 bp, Artificial Sequence
  Description of Artificial Sequence: Synthetic oligonucleotide
tttgtctgggattgccgccc

SEQ ID NO: 2318 - DNA, 20 bp, Artificial Sequence
  Description of Artificial Sequence: Synthetic oligonucleotide
atggtgtgttactttgccgc

SEQ ID NO: 2319 - DNA, 20 bp, Artificial Sequence
  Description of Artificial Sequence: Synthetic oligonucleotide
atgtatgttgggagccacgg

SEQ ID NO: 2320 - DNA, 20 bp, Artificial Sequence
  Description of Artificial Sequence: Synthetic oligonucleotide
tctacacatatccccgtgtg

SEQ ID NO: 2321 - DNA, 20 bp, Artificial Sequence
  Description of Artificial Sequence: Synthetic oligonucleotide
tctacacatttcccgttgtg

SEQ ID NO: 2322 - RNA, 51 nt, Artificial Sequence
  Description of Artificial Sequence: Synthetic oligonucleotide
gggaggacgaugcgguccugucgucuguucguccccagacgacucgcccga

SEQ ID NO: 2323 - RNA, 52 nt, Artificial Sequence
  Description of Artificial Sequence: Synthetic oligonucleotide
gggaggacgaugcggguccugucgucuguucguccccagacgacucgcccga

SEQ ID NO: 2324 - RNA, 51 nt, Artificial Sequence
  Description of Artificial Sequence: Synthetic oligonucleotide
gggaggacgaugcggcccugucgucuguucguccccagacgacucgcccga

SEQ ID NO: 2325 - RNA, 51 nt, Artificial Sequence
  Description of Artificial Sequence: Synthetic oligonucleotide
gggaggacgaugcgguccuggcuugucguuguccccagacgacucgcccga

SEQ ID NO: 2326 - RNA, 51 nt, Artificial Sequence
  Description of Artificial Sequence: Synthetic oligonucleotide
gggaggacgaugcggucuugucgucuguucguccccagacgacucgcccga

SEQ ID NO: 2327 - RNA, 51 nt, Artificial Sequence
  Description of Artificial Sequence: Synthetic oligonucleotide
gggaggacgaugcgguuugggguuuucccgugccccagacgacucgcccga

SEQ ID NO: 2328 - RNA, 51 nt, Artificial Sequence
  Description of Artificial Sequence: Synthetic oligonucleotide
gggaggacgaugcgguccugucgucuguucguucccagacgacucgcccga

SEQ ID NO: 2329 - RNA, 51 nt, Artificial Sequence
  Description of Artificial Sequence: Synthetic oligonucleotide
gggaggacgaugcgggcguuuccucuguucguccccagacgacucgcccga

SEQ ID NO: 2330 - RNA, 51 nt, Artificial Sequence
  Description of Artificial Sequence: Synthetic oligonucleotide
gggaggacgaugcggcguuuccucugguucguccccagacgacucgcccga

SEQ ID NO: 2331 - RNA, 51 nt, Artificial Sequence
  Description of Artificial Sequence: Synthetic oligonucleotide
gggaggacgaugcgguccugucgucuguucguuuccagacgacucgcccga

SEQ ID NO: 2332 - RNA, 50 nt, Artificial Sequence
  Description of Artificial Sequence: Synthetic oligonucleotide
gggaggacgaugcgguccugucgucuguucgucccagacgacucgcccga

SEQ ID NO: 2333 - RNA, 51 nt, Artificial Sequence
  Description of Artificial Sequence: Synthetic oligonucleotide
gggaggacgaugcgguccugucgucugcucguccccagacgacucgcccga

SEQ ID NO: 2334 - RNA, 51 nt, Artificial Sequence
  Description of Artificial Sequence: Synthetic oligonucleotide
gggaggacgaugcggugagucguucccuucguccccagacgacucgcccga

SEQ ID NO: 2335 - RNA, 51 nt, Artificial Sequence
  Description of Artificial Sequence: Synthetic oligonucleotide
gggaggacgaugcgggccuuucguucugaccuccccagacgacucgcccga

SEQ ID NO: 2336 - RNA, 51 nt, Artificial Sequence
  Description of Artificial Sequence: Synthetic oligonucleotide
gggaggacgaugcggugcugucgucuguucguccccagacgacucgcccga

SEQ ID NO: 2337 - RNA, 51 nt, Artificial Sequence
  Description of Artificial Sequence: Synthetic oligonucleotide
gggaggacgaugcgguccugucgucuguuuguccccagacgacucgcccga

SEQ ID NO: 2338 - RNA, 51 nt, Artificial Sequence
  Description of Artificial Sequence: Synthetic oligonucleotide
gggaggacgaugcggucccgucgucuguucguccccagacgacucgcccga

SEQ ID NO: 2339 - RNA, 51 nt, Artificial Sequence
  Description of Artificial Sequence: Synthetic oligonucleotide
gggaggacgaugcgguccugucgucuguuccuccccagacgacucgcccga

SEQ ID NO: 2340 - RNA, 50 nt, Artificial Sequence
  Description of Artificial Sequence: Synthetic oligonucleotide
gggaggacgaugcggccugucgucuguucguccccagacgacucgcccga

SEQ ID NO: 2341 - RNA, 51 nt, Artificial Sequence
  Description of Artificial Sequence: Synthetic oligonucleotide
gggaggacgaugcgguccugucgucuguccguccccagacgacucgcccga

SEQ ID NO: 2342 - RNA, 52 nt, Artificial Sequence
  Description of Artificial Sequence: Synthetic oligonucleotide
gggaggacgaugcgguuugggguuuuucccgugccccagacgacucgcccga

SEQ ID NO: 2343 - RNA, 51 nt, Artificial Sequence
  Description of Artificial Sequence: Synthetic oligonucleotide
gggaggacgaugcgggcuugucuucuguucguccccagacgacucgcccga

SEQ ID NO: 2344 - RNA, 50 nt, Artificial Sequence
  Description of Artificial Sequence: Synthetic oligonucleotide
gggaggacgaugcggucugugugggauguggccccagacgacucgcccga

SEQ ID NO: 2345 - RNA, 51 nt, Artificial Sequence
  Description of Artificial Sequence: Synthetic oligonucleotide
gggaggacgaugcgguccugucgucuguucgcccccagacgacucgcccga

SEQ ID NO: 2346 - RNA, 50 nt, Artificial Sequence
  Description of Artificial Sequence: Synthetic oligonucleotide
gggaggacgaugcgguccugucgucugucguccccagacgacucgcccga

SEQ ID NO: 2347 - RNA, 51 nt, Artificial Sequence
  Description of Artificial Sequence: Synthetic oligonucleotide
gggaggacgaugcgguccugucgucucuucguccccagacgacucgcccga

SEQ ID NO: 2348 - RNA, 51 nt, Artificial Sequence
  Description of Artificial Sequence: Synthetic oligonucleotide
gggaggacgaugcggucucaguagugggccugcugcagacgacucgcccga

SEQ ID NO: 2349 - RNA, 51 nt, Artificial Sequence
  Description of Artificial Sequence: Synthetic oligonucleotide
gggaggacgaugcgguccugucgccuguucguccccagacgacucgcccga

SEQ ID NO: 2350 - RNA, 52 nt, Artificial Sequence
  Description of Artificial Sequence: Synthetic oligonucleotide
gggaggacgaugcggucuguugugcuugauaugccccagacgacucgcccga

SEQ ID NO: 2351 - RNA, 51 nt, Artificial Sequence
  Description of Artificial Sequence: Synthetic oligonucleotide
gggaggacgaugcgguccugucgucuuuucguccccagacgacucgcccga

SEQ ID NO: 2352 - RNA, 51 nt, Artificial Sequence
  Description of Artificial Sequence: Synthetic oligonucleotide
gggaggacgaugcgguccugccgucuguucguccccagacgacucgcccga

SEQ ID NO: 2353 - RNA, 51 nt, Artificial Sequence
  Description of Artificial Sequence: Synthetic oligonucleotide
gggaggacgaugcgguccugucgucuguucgucuccagacgacucgcccga

SEQ ID NO: 2354 - RNA, 51 nt, Artificial Sequence
  Description of Artificial Sequence: Synthetic oligonucleotide
gggaggacgaugcgguccugucgucuguucguacccagacgacucgcccga

SEQ ID NO: 2355 - RNA, 51 nt, Artificial Sequence
  Description of Artificial Sequence: Synthetic oligonucleotide
gggaggacgaugcgguccugucgucuguucauccccagacgacucgcccga

SEQ ID NO: 2356 - RNA, 51 nt, Artificial Sequence
  Description of Artificial Sequence: Synthetic oligonucleotide
gggaggacgaugcgguccugucguccguucguccccagacgacucgcccga

SEQ ID NO: 2357 - RNA, 51 nt, Artificial Sequence
  Description of Artificial Sequence: Synthetic oligonucleotide
gggaggacgaugcgggccuucucgucuguuguccccagacgacucgcccga

SEQ ID NO: 2358 - RNA, 51 nt, Artificial Sequence
  Description of Artificial Sequence: Synthetic oligonucleotide
gggaggacgaugcgguccuguugucuguucguccccagacgacucgcccga

SEQ ID NO: 2359 - RNA, 51 nt, Artificial Sequence
  Description of Artificial Sequence: Synthetic oligonucleotide
gggaggacgaugcgguccugucgucuguucuuccccagacgacucgcccga

SEQ ID NO: 2360 - RNA, 51 nt, Artificial Sequence
  Description of Artificial Sequence: Synthetic oligonucleotide
gggaggacgaugcgguccugucgucuauucguccccagacgacucgcccga

SEQ ID NO: 2361 - RNA, 50 nt, Artificial Sequence
  Description of Artificial Sequence: Synthetic oligonucleotide
gggaggacgaugcgguccugucgucuguuguccccagacgacucgcccga

SEQ ID NO: 2362 - RNA, 51 nt, Artificial Sequence
  Description of Artificial Sequence: Synthetic oligonucleotide
gggaggacgaugcggugacucgucuguuucguccccagacgacucgcccga

SEQ ID NO: 2363 - RNA, 51 nt, Artificial Sequence
  Description of Artificial Sequence: Synthetic oligonucleotide
gggaggacgaugcgguccugucgucuguucguccucagacgacucgcccga

SEQ ID NO: 2364 - RNA, 51 nt, Artificial Sequence
  Description of Artificial Sequence: Synthetic oligonucleotide
gggaggacgaugcgguccugucguuuguucguccccagacgacucgcccga

SEQ ID NO: 2365 - RNA, 51 nt, Artificial Sequence
  Description of Artificial Sequence: Synthetic oligonucleotide
gggaggacgaugcgguccugucgucuguucguccacagacgacucgcccga

SEQ ID NO: 2366 - RNA, 51 nt, Artificial Sequence
  Description of Artificial Sequence: Synthetic oligonucleotide
gggaggacgaugcgguccugucaucuguucguccccagacgacucgcccga

SEQ ID NO: 2367 - RNA, 51 nt, Artificial Sequence
  Description of Artificial Sequence: Synthetic oligonucleotide
gggaggacgaugcgguccugucgucuguuaguccccagacgacucgcccga

SEQ ID NO: 2368 - RNA, 51 nt, Artificial Sequence
  Description of Artificial Sequence: Synthetic oligonucleotide
gggaggacgaugcgguccuaucgucuguucguccccagacgacucgcccga

SEQ ID NO: 2369 - RNA, 51 nt, Artificial Sequence
  Description of Artificial Sequence: Synthetic oligonucleotide
gggaggacgaugcgguccugucgucugucuguccccagacgacucgcccga

SEQ ID NO: 2370 - RNA, 50 nt, Artificial Sequence
  Description of Artificial Sequence: Synthetic oligonucleotide
gggaggacgaugcgguccugucgucuguucguuccagacgacucgcccga

SEQ ID NO: 2371 - RNA, 51 nt, Artificial Sequence
  Description of Artificial Sequence: Synthetic oligonucleotide
gggaggacgaugcgguucugucgucuguucguccccagacgacucgcccga

SEQ ID NO: 2372 - RNA, 51 nt, Artificial Sequence
  Description of Artificial Sequence: Synthetic oligonucleotide
gggaggacgaugcggugucguagucuauccgcccgcagacgacucgcccga

SEQ ID NO: 2373 - RNA, 51 nt, Artificial Sequence
  Description of Artificial Sequence: Synthetic oligonucleotide
gggaggacgaugcgguccugucgucugaucguccccagacgacucgcccga

SEQ ID NO: 2374 - RNA, 51 nt, Artificial Sequence
  Description of Artificial Sequence: Synthetic oligonucleotide
gggaggacgaugcggcgacuccucuguucccuccccagacgacucgcccga

SEQ ID NO: 2375 - RNA, 51 nt, Artificial Sequence
  Description of Artificial Sequence: Synthetic oligonucleotide
gggaggacgaugcggguccugucgucuuacguccccagacgacucgcccga

SEQ ID NO: 2376 - RNA, 51 nt, Artificial Sequence
  Description of Artificial Sequence: Synthetic oligonucleotide
gggaggacgaugcggauguauguugggagccacgccagacgacucgcccga

SEQ ID NO: 2377 - RNA, 51 nt, Artificial Sequence
  Description of Artificial Sequence: Synthetic oligonucleotide
gggaggacgaugcgguccagucgucuguucguccccagacgacucgcccga

SEQ ID NO: 2378 - RNA, 51 nt, Artificial Sequence
  Description of Artificial Sequence: Synthetic oligonucleotide
gggaggacgaugcggucaugucgucuguucguccccagacgacucgcccga

SEQ ID NO: 2379 - RNA, 50 nt, Artificial Sequence
  Description of Artificial Sequence: Synthetic oligonucleotide
gggaggacgaugcgggacuguauggggcucugugcagacgacucgcccga

SEQ ID NO: 2380 - RNA, 50 nt, Artificial Sequence
  Description of Artificial Sequence: Synthetic oligonucleotide
gggaggacgaugcgguccugucgucuuucguccccagacgacucgcccga

SEQ ID NO: 2381 - RNA, 48 nt, Artificial Sequence
  Description of Artificial Sequence: Synthetic oligonucleotide
gggaggacgaugcgguccugucgucuguuccccagacgacucgcccga

SEQ ID NO: 2382 - RNA, 53 nt, Artificial Sequence
  Description of Artificial Sequence: Synthetic oligonucleotide
gggaggacgaugcgggccuucucgucuguuguccccccagacgacucgcccga

SEQ ID NO: 2383 - RNA, 51 nt, Artificial Sequence
  Description of Artificial Sequence: Synthetic oligonucleotide
gggaggacgaugcgggccauucgucuuuucguccccagacgacucgcccga

SEQ ID NO: 2384 - RNA, 51 nt, Artificial Sequence
  Description of Artificial Sequence: Synthetic oligonucleotide
gggaggacgaugcgguccuguagucuguucguccccagacgacucgcccga

SEQ ID NO: 2385 - RNA, 52 nt, Artificial Sequence
  Description of Artificial Sequence: Synthetic oligonucleotide
gggaggacgaugcgguccugucgucuguuucguccccagacgacucgcccga

SEQ ID NO: 2386 - RNA, 51 nt, Artificial Sequence
  Description of Artificial Sequence: Synthetic oligonucleotide
gggaggacgaugcggcgaccuucgucugcacuccccagacgacucgcccga

SEQ ID NO: 2387 - RNA, 50 nt, Artificial Sequence
  Description of Artificial Sequence: Synthetic oligonucleotide
gggaggacgaugcgguccugucgucuguucuccccagacgacucgcccga

SEQ ID NO: 2388 - RNA, 51 nt, Artificial Sequence
  Description of Artificial Sequence: Synthetic oligonucleotide
gggaggacgaugcgguccugucguauguucguccccagacgacucgcccga

SEQ ID NO: 2389 - RNA, 51 nt, Artificial Sequence
  Description of Artificial Sequence: Synthetic oligonucleotide
gggaggacgaugcggcgauuccucugguucguccccagacgacucgcccga

SEQ ID NO: 2390 - RNA, 51 nt, Artificial Sequence
  Description of Artificial Sequence: Synthetic oligonucleotide
gggaggacgaugcgguccugucgucuguugguccccagacgacucgcccga

SEQ ID NO: 2391 - RNA, 51 nt, Artificial Sequence
  Description of Artificial Sequence: Synthetic oligonucleotide
gggaggacgaugcgguccugucgucuguucgucaccagacgacucgcccga

SEQ ID NO: 2392 - RNA, 51 nt, Artificial Sequence
  Description of Artificial Sequence: Synthetic oligonucleotide
gggaggacgaugcggcugucuaccuucuacugccgcagacgacucgcccga

SEQ ID NO: 2393 - RNA, 51 nt, Artificial Sequence
  Description of Artificial Sequence: Synthetic oligonucleotide
gggaggacgaugcggaccugucgucuguucguccccagacgacucgcccga

SEQ ID NO: 2394 - RNA, 48 nt, Artificial Sequence
  Description of Artificial Sequence: Synthetic oligonucleotide
gggaggacgaugcgguccugucgucucguccccagacgacucgcccga

SEQ ID NO: 2395 - RNA, 51 nt, Artificial Sequence
  Description of Artificial Sequence: Synthetic oligonucleotide
gggaggacgaugcgguccuguccucuguucguccccagacgacucgcccga

SEQ ID NO: 2396 - RNA, 51 nt, Artificial Sequence
  Description of Artificial Sequence: Synthetic oligonucleotide
gggaggacgaugcgguccucucgucuguucguccccagacgacucgcccga

SEQ ID NO: 2397 - RNA, 51 nt, Artificial Sequence
  Description of Artificial Sequence: Synthetic oligonucleotide
gggaggacgaugcgguccugacgucuguucguccccagacgacucgcccga

SEQ ID NO: 2398 - RNA, 51 nt, Artificial Sequence
  Description of Artificial Sequence: Synthetic oligonucleotide
gggaggacgaugcgguccugucgucuguucguccgcagacgacucgcccga

SEQ ID NO: 2399 - RNA, 51 nt, Artificial Sequence
  Description of Artificial Sequence: Synthetic oligonucleotide
gggaggacgaugcgguccugucgucuguucgaccccagacgacucgcccga

SEQ ID NO: 2400 - RNA, 50 nt, Artificial Sequence
  Description of Artificial Sequence: Synthetic oligonucleotide
gggaggacgaugcggucugucgucuguucguccccagacgacucgcccga

SEQ ID NO: 2401 - RNA, 51 nt, Artificial Sequence
  Description of Artificial Sequence: Synthetic oligonucleotide
gggaggacgaugcgguccugucgucuguacguccccagacgacucgcccga

SEQ ID NO: 2402 - RNA, 51 nt, Artificial Sequence
  Description of Artificial Sequence: Synthetic oligonucleotide
gggaggacgaugcgguuugggguuucuucccgccccagacgacucgcccga

SEQ ID NO: 2403 - RNA, 52 nt, Artificial Sequence
  Description of Artificial Sequence: Synthetic oligonucleotide
gggaggacgaugcgguccugucgucuguucguuccccagacgacucgcccga

SEQ ID NO: 2404 - RNA, 51 nt, Artificial Sequence
  Description of Artificial Sequence: Synthetic oligonucleotide
gggaggacgaugcgggccuucuucugguucguccccagacgacucgcccga

SEQ ID NO: 2405 - RNA, 51 nt, Artificial Sequence
  Description of Artificial Sequence: Synthetic oligonucleotide
gggaggacgaugcggcgaugcuuacgugcacgcgccagacgacucgcccga

SEQ ID NO: 2406 - RNA, 51 nt, Artificial Sequence
  Description of Artificial Sequence: Synthetic oligonucleotide
gggaggacgaugcggguguuucgucucuucguccccagacgacucgcccga

SEQ ID NO: 2407 - RNA, 51 nt, Artificial Sequence
  Description of Artificial Sequence: Synthetic oligonucleotide
gggaggacgaugcgguccugucgucaguucguccccagacgacucgcccga

SEQ ID NO: 2408 - RNA, 50 nt, Artificial Sequence
  Description of Artificial Sequence: Synthetic oligonucleotide
gggaggacgaugcgguuugggguuucccgugccccagacgacucgcccga

SEQ ID NO: 2409 - RNA, 51 nt, Artificial Sequence
  Description of Artificial Sequence: Synthetic oligonucleotide
gggaggacgaugcggcuguauguugguagccacgccagacgacucgcccga

SEQ ID NO: 2410 - RNA, 51 nt, Artificial Sequence
  Description of Artificial Sequence: Synthetic oligonucleotide
gggaggacgaugcggcgacucgaucuguucguccccagacgacucgcccga

SEQ ID NO: 2411 - RNA, 51 nt, Artificial Sequence
  Description of Artificial Sequence: Synthetic oligonucleotide
gggaggacgaugcggugcguuucgucucgcguccccagacgacucgcccga

SEQ ID NO: 2412 - RNA, 51 nt, Artificial Sequence
  Description of Artificial Sequence: Synthetic oligonucleotide
gggaggacgaugcgguccugucgucuguucgguuccagacgacucgcccga

SEQ ID NO: 2413 - RNA, 51 nt, Artificial Sequence
  Description of Artificial Sequence: Synthetic oligonucleotide
gggaggacgaugcgguugacucgucugcugcuccccagacgacucgcccga

SEQ ID NO: 2414 - RNA, 51 nt, Artificial Sequence
  Description of Artificial Sequence: Synthetic oligonucleotide
gggaggacgaugcgguccugucuucuguucguccccagacgacucgcccga

SEQ ID NO: 2415 - RNA, 51 nt, Artificial Sequence
  Description of Artificial Sequence: Synthetic oligonucleotide
gggaggacgaugcggccgacucguucugcacuccccagacgacucgcccga

SEQ ID NO: 2416 - RNA, 51 nt, Artificial Sequence
  Description of Artificial Sequence: Synthetic oligonucleotide
gggaggacgaugcggcguucgucuguuugggccgccagacgacucgcccga

SEQ ID NO: 2417 - RNA, 51 nt, Artificial Sequence
  Description of Artificial Sequence: Synthetic oligonucleotide
gggaggacgaugcggccugucgucuuuuucguccccagacgacucgcccga

SEQ ID NO: 2418 - RNA, 51 nt, Artificial Sequence
  Description of Artificial Sequence: Synthetic oligonucleotide
gggaggacgaugcgguacugucgucuguucguccccagacgacucgcccga

SEQ ID NO: 2419 - RNA, 50 nt, Artificial Sequence
  Description of Artificial Sequence: Synthetic oligonucleotide
gggaggacgaugcgguccgucgucuguucguccccagacgacucgcccga

SEQ ID NO: 2420 - RNA, 51 nt, Artificial Sequence
  Description of Artificial Sequence: Synthetic oligonucleotide
gggaggacgaugcgguccuuucgucuguucguccccagacgacucgcccga

SEQ ID NO: 2421 - RNA, 51 nt, Artificial Sequence
  Description of Artificial Sequence: Synthetic oligonucleotide
gggaggacgaugcggcgacucguucuguccguccccagacgacucgcccga

SEQ ID NO: 2422 - RNA, 53 nt, Artificial Sequence
  Description of Artificial Sequence: Synthetic oligonucleotide
gggaggacgaugcgguuugggguuuuuucccgugccccagacgacucgcccga

SEQ ID NO: 2423 - RNA, 51 nt, Artificial Sequence
  Description of Artificial Sequence: Synthetic oligonucleotide
gggaggacgaugcgguccugucgucuguucgugcccagacgacucgcccga

SEQ ID NO: 2424 - RNA, 51 nt, Artificial Sequence
  Description of Artificial Sequence: Synthetic oligonucleotide
gggaggacgaugcggugccuuucgucugcacuccccagacgacucgcccga

SEQ ID NO: 2425 - RNA, 51 nt, Artificial Sequence
  Description of Artificial Sequence: Synthetic oligonucleotide
gggaggacgaugcgguggugugucaagguacgcgccagacgacucgcccga

SEQ ID NO: 2426 - RNA, 51 nt, Artificial Sequence
  Description of Artificial Sequence: Synthetic oligonucleotide
gggaggacgaugcgguccggucgucuguucguccccagacgacucgcccga

SEQ ID NO: 2427 - RNA, 49 nt, Artificial Sequence
  Description of Artificial Sequence: Synthetic oligonucleotide
gggaggacgaugcgggacuguacgggcucugugcagacgacucgcccga

SEQ ID NO: 2428 - RNA, 49 nt, Artificial Sequence
  Description of Artificial Sequence: Synthetic oligonucleotide
gggaggacgaugcgguccugucgucuucguccccagacgacucgcccga

SEQ ID NO: 2429 - RNA, 51 nt, Artificial Sequence
  Description of Artificial Sequence: Synthetic oligonucleotide
gggaggacgaugcgguccugucgucuggucguccccagacgacucgcccga

SEQ ID NO: 2430 - RNA, 51 nt, Artificial Sequence
  Description of Artificial Sequence: Synthetic oligonucleotide
gggaggacgaugcgguccugucgucuguucgucgccagacgacucgcccga

SEQ ID NO: 2431 - RNA, 51 nt, Artificial Sequence
  Description of Artificial Sequence: Synthetic oligonucleotide
gggaggacgaugcgggugcucucgucugcacuccccagacgacucgcccga

SEQ ID NO: 2432 - RNA, 52 nt, Artificial Sequence
  Description of Artificial Sequence: Synthetic oligonucleotide
gggaggacgaugcgguccugucgucugucucguccccagacgacucgcccga

SEQ ID NO: 2433 - RNA, 51 nt, Artificial Sequence
  Description of Artificial Sequence: Synthetic oligonucleotide
gggaggacgaugcggccuugucgucuguucguccccagacgacucgcccga

SEQ ID NO: 2434 - RNA, 51 nt, Artificial Sequence
  Description of Artificial Sequence: Synthetic oligonucleotide
gggaggacgaugcggcgagcuccucuguucguccccagacgacucgcccga

SEQ ID NO: 2435 - RNA, 51 nt, Artificial Sequence
  Description of Artificial Sequence: Synthetic oligonucleotide
gggaggacgaugcgggccuuucguuuguucguccccagacgacucgcccga

SEQ ID NO: 2436 - RNA, 51 nt, Artificial Sequence
  Description of Artificial Sequence: Synthetic oligonucleotide
gggaggacgaugcggccugucguucuguucguccccagacgacucgcccga

SEQ ID NO: 2437 - RNA, 50 nt, Artificial Sequence
  Description of Artificial Sequence: Synthetic oligonucleotide
gggaggacgaugcgguccugucgucuguuccccccagacgacucgcccga

SEQ ID NO: 2438 - RNA, 52 nt, Artificial Sequence
  Description of Artificial Sequence: Synthetic oligonucleotide
gggaggacgaugcggucgaucgucugauuucguccccagacgacucgcccga

SEQ ID NO: 2439 - RNA, 51 nt, Artificial Sequence
  Description of Artificial Sequence: Synthetic oligonucleotide
gggaggacgaugcggucgugucgucuguucguccccagacgacucgcccga

SEQ ID NO: 2440 - RNA, 51 nt, Artificial Sequence
  Description of Artificial Sequence: Synthetic oligonucleotide
gggaggacgaugcggcgaccucgucuguugcuccccagacgacucgcccga

SEQ ID NO: 2441 - RNA, 51 nt, Artificial Sequence
  Description of Artificial Sequence: Synthetic oligonucleotide
gggaggacgaugcgguccugucguguguucguccccagacgacucgcccga

SEQ ID NO: 2442 - RNA, 51 nt, Artificial Sequence
  Description of Artificial Sequence: Synthetic oligonucleotide
gggaggacgaugcggcuugucgucuuguucguccccagacgacucgcccga

SEQ ID NO: 2443 - RNA, 51 nt, Artificial Sequence
  Description of Artificial Sequence: Synthetic oligonucleotide
gggaggacgaugcgguccugucgacuguucguccccagacgacucgcccga

SEQ ID NO: 2444 - RNA, 51 nt, Artificial Sequence
  Description of Artificial Sequence: Synthetic oligonucleotide
gggaggacgaugcgguccugucgucgguucguccccagacgacucgcccga

SEQ ID NO: 2445 - RNA, 51 nt, Artificial Sequence
  Description of Artificial Sequence: Synthetic oligonucleotide
gggaggacgaugcgggccuucgucuuguucguccccagacgacucgcccga

SEQ ID NO: 2446 - RNA, 50 nt, Artificial Sequence
  Description of Artificial Sequence: Synthetic oligonucleotide
gggaggacgaugcgguccugugucuguucguccccagacgacucgcccga

SEQ ID NO: 2447 - RNA, 49 nt, Artificial Sequence
  Description of Artificial Sequence: Synthetic oligonucleotide
gggaggacgaugcgguccugucgucuguucccccagacgacucgcccga

SEQ ID NO: 2448 - RNA, 51 nt, Artificial Sequence
  Description of Artificial Sequence: Synthetic oligonucleotide
gggaggacgaugcgguccugucgucuguucggccccagacgacucgcccga

SEQ ID NO: 2449 - RNA, 49 nt, Artificial Sequence
  Description of Artificial Sequence: Synthetic oligonucleotide
gggaggacgaugcgguccugucgucuguucguccagacgacucgcccga

SEQ ID NO: 2450 - RNA, 51 nt, Artificial Sequence
  Description of Artificial Sequence: Synthetic oligonucleotide
gggaggacgaugcggugugucggucugcugcuccccagacgacucgcccga

SEQ ID NO: 2451 - RNA, 52 nt, Artificial Sequence
  Description of Artificial Sequence: Synthetic oligonucleotide
gggaggacgaugcgguccugucgucuguucgucccccagacgacucgcccga

SEQ ID NO: 2452 - RNA, 51 nt, Artificial Sequence
  Description of Artificial Sequence: Synthetic oligonucleotide
gggaggacgaugcgggccucucgucugcuucuccccagacgacucgcccga

SEQ ID NO: 2453 - RNA, 52 nt, Artificial Sequence
  Description of Artificial Sequence: Synthetic oligonucleotide
gggaggacgaugcggguguucgucuguuuucguccccagacgacucgcccga

SEQ ID NO: 2454 - RNA, 51 nt, Artificial Sequence
  Description of Artificial Sequence: Synthetic oligonucleotide
gggaggacgaugcgguccugucgucucgucguccccagacgacucgcccga

SEQ ID NO: 2455 - RNA, 51 nt, Artificial Sequence
  Description of Artificial Sequence: Synthetic oligonucleotide
gggaggacgaugcggugcgucucgucucugucccccagacgacucgcccga

SEQ ID NO: 2456 - RNA, 52 nt, Artificial Sequence
  Description of Artificial Sequence: Synthetic oligonucleotide
gggaggacgaugcggucugcugugcuugauaugccccagacgacucgcccga

SEQ ID NO: 2457 - RNA, 52 nt, Artificial Sequence
  Description of Artificial Sequence: Synthetic oligonucleotide
gggaggacgaugcgggugcucgucuguuuucguccccagacgacucgcccga

SEQ ID NO: 2458 - RNA, 51 nt, Artificial Sequence
  Description of Artificial Sequence: Synthetic oligonucleotide
gggaggacgaugcggcgauuccucuguccccuccccagacgacucgcccga

SEQ ID NO: 2459 - RNA, 51 nt, Artificial Sequence
  Description of Artificial Sequence: Synthetic oligonucleotide
gggaggacgaugcgggccuuuucgucuugccuccccagacgacucgcccga

SEQ ID NO: 2460 - RNA, 50 nt, Artificial Sequence
  Description of Artificial Sequence: Synthetic oligonucleotide
gggaggacgaugcgguccugucgucugcuguccccagacgacucgcccga

SEQ ID NO: 2461 - RNA, 51 nt, Artificial Sequence
  Description of Artificial Sequence: Synthetic oligonucleotide
gggaggacgaugcgggccuucguucugagccuccccagacgacucgcccga

SEQ ID NO: 2462 - RNA, 51 nt, Artificial Sequence
  Description of Artificial Sequence: Synthetic oligonucleotide
gggaggacgaugcgguccuggcuugucguuguucccagacgacucgcccga

SEQ ID NO: 2463 - RNA, 51 nt, Artificial Sequence
  Description of Artificial Sequence: Synthetic oligonucleotide
gggaggacgaugcggcgacuccucugaucccuccccagacgacucgcccga

SEQ ID NO: 2464 - RNA, 51 nt, Artificial Sequence
  Description of Artificial Sequence: Synthetic oligonucleotide
gggaggacgaugcgguccugucgucuguucguacacagacgacucgcccga

SEQ ID NO: 2465 - RNA, 51 nt, Artificial Sequence
  Description of Artificial Sequence: Synthetic oligonucleotide
gggaggacgaugcgguccagucguucuguugccgccagacgacucgcccga

SEQ ID NO: 2466 - RNA, 50 nt, Artificial Sequence
  Description of Artificial Sequence: Synthetic oligonucleotide
gggaggacgaugcgguccugucgucucucguccccagacgacucgcccga

SEQ ID NO: 2467 - RNA, 51 nt, Artificial Sequence
  Description of Artificial Sequence: Synthetic oligonucleotide
gggaggacgaugcggcuucucgucuguucccuccccagacgacucgcccga

SEQ ID NO: 2468 - RNA, 51 nt, Artificial Sequence
  Description of Artificial Sequence: Synthetic oligonucleotide
gggaggacgaugcgguccugucgucugguuguccccagacgacucgcccga

SEQ ID NO: 2469 - RNA, 51 nt, Artificial Sequence
  Description of Artificial Sequence: Synthetic oligonucleotide
gggaggacgaugcggcgcuucaacuggaccucccccagacgacucgcccga

SEQ ID NO: 2470 - RNA, 50 nt, Artificial Sequence
  Description of Artificial Sequence: Synthetic oligonucleotide
gggaggacgaugcgguccugucgucuguucgccccagacgacucgcccga

SEQ ID NO: 2471 - RNA, 51 nt, Artificial Sequence
  Description of Artificial Sequence: Synthetic oligonucleotide
gggaggacgaugcggcccugucgucuguucguucccagacgacucgcccga

SEQ ID NO: 2472 - RNA, 51 nt, Artificial Sequence
  Description of Artificial Sequence: Synthetic oligonucleotide
gggaggacgaugcgggugcucgucuguuucguccccagacgacucgcccga

SEQ ID NO: 2473 - RNA, 50 nt, Artificial Sequence
  Description of Artificial Sequence: Synthetic oligonucleotide
gggaggacgaugcgguccugucgucguucguccccagacgacucgcccga

SEQ ID NO: 2474 - RNA, 51 nt, Artificial Sequence
  Description of Artificial Sequence: Synthetic oligonucleotide
gggaggacgaugcgguccugucggcuguucguccccagacgacucgcccga

SEQ ID NO: 2475 - RNA, 51 nt, Artificial Sequence
  Description of Artificial Sequence: Synthetic oligonucleotide
gggaggacgaugcgguccuguggucuguucguccccagacgacucgcccga

SEQ ID NO: 2476 - RNA, 51 nt, Artificial Sequence
  Description of Artificial Sequence: Synthetic oligonucleotide
gggaggacgaugcggcgcgucuucuguuucguccccagacgacucgcccga

SEQ ID NO: 2477 - RNA, 51 nt, Artificial Sequence
  Description of Artificial Sequence: Synthetic oligonucleotide
gggaggacgaugcggcgagcuucugauuucguccccagacgacucgcccga

SEQ ID NO: 2478 - RNA, 52 nt, Artificial Sequence
  Description of Artificial Sequence: Synthetic oligonucleotide
gggaggacgaugcggguccugucgucuguucguucccagacgacucgcccga

SEQ ID NO: 2479 - RNA, 49 nt, Artificial Sequence
  Description of Artificial Sequence: Synthetic oligonucleotide
gggaggacgaugcgguccugucgucuccguccccagacgacucgcccga

SEQ ID NO: 2480 - RNA, 51 nt, Artificial Sequence
  Description of Artificial Sequence: Synthetic oligonucleotide
gggaggacgaugcgggcuucucgucugaaccuccccagacgacucgcccga

SEQ ID NO: 2481 - RNA, 51 nt, Artificial Sequence
  Description of Artificial Sequence: Synthetic oligonucleotide
gggaggacgaugcggaugugguguuugcuuagcugcagacgacucgcccga

SEQ ID NO: 2482 - RNA, 50 nt, Artificial Sequence
  Description of Artificial Sequence: Synthetic oligonucleotide
gggaggacgaugcgguccugucguccgucguccccagacgacucgcccga

SEQ ID NO: 2483 - RNA, 51 nt, Artificial Sequence
  Description of Artificial Sequence: Synthetic oligonucleotide
gggaggacgaugcggccuuucgucugguucguccccagacgacucgcccga

SEQ ID NO: 2484 - RNA, 51 nt, Artificial Sequence
  Description of Artificial Sequence: Synthetic oligonucleotide
gggaggacgaugcgggccuucguuugguucguccccagacgacucgcccga

SEQ ID NO: 2485 - RNA, 51 nt, Artificial Sequence
  Description of Artificial Sequence: Synthetic oligonucleotide
gggaggacgaugcgggccugucuucuguucguccccagacgacucgcccga

SEQ ID NO: 2486 - RNA, 51 nt, Artificial Sequence
  Description of Artificial Sequence: Synthetic oligonucleotide
gggaggacgaugcgggccuuucgucuguucguccccagacgacucgcccga

SEQ ID NO: 2487 - RNA, 51 nt, Artificial Sequence
  Description of Artificial Sequence: Synthetic oligonucleotide
gggaggacgaugcgggucuuucgucugaaccuccccagacgacucgcccga

SEQ ID NO: 2488 - RNA, 51 nt, Artificial Sequence
  Description of Artificial Sequence: Synthetic oligonucleotide
gggaggacgaugcggcccugucgucuguucguuuccagacgacucgcccga

SEQ ID NO: 2489 - RNA, 51 nt, Artificial Sequence
  Description of Artificial Sequence: Synthetic oligonucleotide
gggaggacgaugcggcguuucuucugguucguccccagacgacucgcccga

SEQ ID NO: 2490 - RNA, 51 nt, Artificial Sequence
  Description of Artificial Sequence: Synthetic oligonucleotide
gggaggacgaugcggucucuggguuugugcugccccagacgacucgcccga

SEQ ID NO: 2491 - RNA, 51 nt, Artificial Sequence
  Description of Artificial Sequence: Synthetic oligonucleotide
gggaggacgaugcgguccuggcgucuguucguccccagacgacucgcccga

SEQ ID NO: 2492 - RNA, 51 nt, Artificial Sequence
  Description of Artificial Sequence: Synthetic oligonucleotide
gggaggacgaugcgguccagucgucuuugcguccccagacgacucgcccga

SEQ ID NO: 2493 - RNA, 49 nt, Artificial Sequence
  Description of Artificial Sequence: Synthetic oligonucleotide
gggaggacgaugcgggacuguaugggcucugugcagacgacucgcccga

SEQ ID NO: 2494 - RNA, 51 nt, Artificial Sequence
  Description of Artificial Sequence: Synthetic oligonucleotide
gggaggacgaugcggcgucucgucugacaccuccccagacgacucgcccga

SEQ ID NO: 2495 - RNA, 52 nt, Artificial Sequence
  Description of Artificial Sequence: Synthetic oligonucleotide
gggaggacgaugcgguccugucgucuguuccguccccagacgacucgcccga

SEQ ID NO: 2496 - RNA, 51 nt, Artificial Sequence
  Description of Artificial Sequence: Synthetic oligonucleotide
gggaggacgaugcgggacuagcgaucuguuacgcacagacgacucgcccga

SEQ ID NO: 2497 - RNA, 51 nt, Artificial Sequence
  Description of Artificial Sequence: Synthetic oligonucleotide
gggaggacgaugcggcgcucucgucugcuacuccccagacgacucgcccga

SEQ ID NO: 2498 - RNA, 51 nt, Artificial Sequence
  Description of Artificial Sequence: Synthetic oligonucleotide
gggaggacgaugcgggcguuuccucugcugcuccccagacgacucgcccga

SEQ ID NO: 2499 - RNA, 51 nt, Artificial Sequence
  Description of Artificial Sequence: Synthetic oligonucleotide
gggaggacgaugcggguuugucgucucuucguccccagacgacucgcccga

SEQ ID NO: 2500 - RNA, 51 nt, Artificial Sequence
  Description of Artificial Sequence: Synthetic oligonucleotide
gggaggacgaugcgguccuggcuugucguugcccccagacgacucgcccga

SEQ ID NO: 2501 - RNA, 51 nt, Artificial Sequence
  Description of Artificial Sequence: Synthetic oligonucleotide
gggaggacgaugcggcgcgacuccucuguacuccccagacgacucgcccga

SEQ ID NO: 2502 - RNA, 51 nt, Artificial Sequence
  Description of Artificial Sequence: Synthetic oligonucleotide
gggaggacgaugcgggcuuuucgucucuacguccccagacgacucgcccga

SEQ ID NO: 2503 - RNA, 52 nt, Artificial Sequence
  Description of Artificial Sequence: Synthetic oligonucleotide
gggaggacgaugcggguccugucgucugcucguccccagacgacucgcccga

SEQ ID NO: 2504 - RNA, 51 nt, Artificial Sequence
  Description of Artificial Sequence: Synthetic oligonucleotide
gggaggacgaugcgguccugucgucuguucguauccagacgacucgcccga

SEQ ID NO: 2505 - RNA, 51 nt, Artificial Sequence
  Description of Artificial Sequence: Synthetic oligonucleotide
gggaggacgaugcgguugucuaccuucuacugccgcagacgacucgcccga

SEQ ID NO: 2506 - RNA, 51 nt, Artificial Sequence
  Description of Artificial Sequence: Synthetic oligonucleotide
gggaggacgaugcggcgaucgucuacacucguccccagacgacucgcccga

SEQ ID NO: 2507 - RNA, 50 nt, Artificial Sequence
  Description of Artificial Sequence: Synthetic oligonucleotide
gggaggacgaugcggcccugucgucuguucgucccagacgacucgcccga

SEQ ID NO: 2508 - RNA, 51 nt, Artificial Sequence
  Description of Artificial Sequence: Synthetic oligonucleotide
gggaggacgaugcggcuucucgucuguacccuccccagacgacucgcccga

SEQ ID NO: 2509 - RNA, 52 nt, Artificial Sequence
  Description of Artificial Sequence: Synthetic oligonucleotide
gggaggacgaugcggugccugucgucuguucguccccagacgacucgcccga

SEQ ID NO: 2510 - RNA, 51 nt, Artificial Sequence
  Description of Artificial Sequence: Synthetic oligonucleotide
gggaggacgaugcgguuugggguuuccccgugccccagacgacucgcccga

SEQ ID NO: 2511 - RNA, 51 nt, Artificial Sequence
  Description of Artificial Sequence: Synthetic oligonucleotide
gggaggacgaugcgguuuggggcuuucccgugccccagacgacucgcccga

SEQ ID NO: 2512 - RNA, 51 nt, Artificial Sequence
  Description of Artificial Sequence: Synthetic oligonucleotide
gggaggacgaugcgguccuggccugucguuguccccagacgacucgcccga

SEQ ID NO: 2513 - RNA, 51 nt, Artificial Sequence
  Description of Artificial Sequence: Synthetic oligonucleotide
gggaggacgaugcggcgacucguucugacccuccccagacgacucgcccga

SEQ ID NO: 2514 - RNA, 54 nt, Artificial Sequence
  Description of Artificial Sequence: Synthetic oligonucleotide
gggaggacgaugcggaauuauguguuuuuuugugaccgcagacgacucgcccga

SEQ ID NO: 2515 - RNA, 51 nt, Artificial Sequence
  Description of Artificial Sequence: Synthetic oligonucleotide
gggaggacgaugcgguccugucgucuguucgucuucagacgacucgcccga

SEQ ID NO: 2516 - RNA, 51 nt, Artificial Sequence
  Description of Artificial Sequence: Synthetic oligonucleotide
gggaggacgaugcgggacuguaucggggcucugugcagacgacucgcccga

SEQ ID NO: 2517 - RNA, 51 nt, Artificial Sequence
  Description of Artificial Sequence: Synthetic oligonucleotide
gggaggacgaugcggucccggcuugucguuguccccagacgacucgcccga

SEQ ID NO: 2518 - RNA, 51 nt, Artificial Sequence
  Description of Artificial Sequence: Synthetic oligonucleotide
gggaggacgaugcgguccugucgucugugcguccccagacgacucgcccga

SEQ ID NO: 2519 - RNA, 51 nt, Artificial Sequence
  Description of Artificial Sequence: Synthetic oligonucleotide
gggaggacgaugcggcgacucugucugcugcuccccagacgacucgcccga

SEQ ID NO: 2520 - RNA, 51 nt, Artificial Sequence
  Description of Artificial Sequence: Synthetic oligonucleotide
gggaggacgaugcgguccuggcuugucgucguccccagacgacucgcccga

SEQ ID NO: 2521 - RNA, 51 nt, Artificial Sequence
  Description of Artificial Sequence: Synthetic oligonucleotide
gggaggacgaugcggucuugucgucuguucguucccagacgacucgcccga

SEQ ID NO: 2522 - RNA, 50 nt, Artificial Sequence
  Description of Artificial Sequence: Synthetic oligonucleotide
gggaggacgaugcgguugggguuuucccgugccccagacgacucgcccga

SEQ ID NO: 2523 - RNA, 51 nt, Artificial Sequence
  Description of Artificial Sequence: Synthetic oligonucleotide
gggaggacgaugcggcgucucucgucugcacuccccagacgacucgcccga

SEQ ID NO: 2524 - RNA, 51 nt, Artificial Sequence
  Description of Artificial Sequence: Synthetic oligonucleotide
gggaggacgaugcgggcucuucgucuuugcguccccagacgacucgcccga

SEQ ID NO: 2525 - RNA, 51 nt, Artificial Sequence
  Description of Artificial Sequence: Synthetic oligonucleotide
gggaggacgaugcggucgucucgucuguucguccccagacgacucgcccga

SEQ ID NO: 2526 - RNA, 51 nt, Artificial Sequence
  Description of Artificial Sequence: Synthetic oligonucleotide
gggaggacgaugcggccgauucguucugcccuccccagacgacucgcccga

SEQ ID NO: 2527 - RNA, 52 nt, Artificial Sequence
  Description of Artificial Sequence: Synthetic oligonucleotide
gggaggacgaugcgggcccugucgucuguucguccccagacgacucgcccga

SEQ ID NO: 2528 - RNA, 52 nt, Artificial Sequence
  Description of Artificial Sequence: Synthetic oligonucleotide
gggaggacgaugcggguccugucgucuguuuguccccagacgacucgcccga

SEQ ID NO: 2529 - RNA, 51 nt, Artificial Sequence
  Description of Artificial Sequence: Synthetic oligonucleotide
gggaggacgaugcgguccugucgucuguuaguacccagacgacucgcccga

SEQ ID NO: 2530 - RNA, 51 nt, Artificial Sequence
  Description of Artificial Sequence: Synthetic oligonucleotide
gggaggacgaugcggucggguccucugcuacuccccagacgacucgcccga

SEQ ID NO: 2531 - RNA, 51 nt, Artificial Sequence
  Description of Artificial Sequence: Synthetic oligonucleotide
gggaggacgaugcggcgauuccucuggcucguccccagacgacucgcccga

SEQ ID NO: 2532 - RNA, 51 nt, Artificial Sequence
  Description of Artificial Sequence: Synthetic oligonucleotide
gggaggacgaugcggcccugucgucuguuuguccccagacgacucgcccga

SEQ ID NO: 2533 - RNA, 51 nt, Artificial Sequence
  Description of Artificial Sequence: Synthetic oligonucleotide
gggaggacgaugcggcgacucgaucugcucuuccccagacgacucgcccga

SEQ ID NO: 2534 - RNA, 51 nt, Artificial Sequence
  Description of Artificial Sequence: Synthetic oligonucleotide
gggaggacgaugcgggcuugauucgucuaccuccccagacgacucgcccga

SEQ ID NO: 2535 - RNA, 51 nt, Artificial Sequence
  Description of Artificial Sequence: Synthetic oligonucleotide
gggaggacgaugcggguccugucgucugucguccccagacgacucgcccga

SEQ ID NO: 2536 - RNA, 51 nt, Artificial Sequence
  Description of Artificial Sequence: Synthetic oligonucleotide
gggaggacgaugcggguccugucgucuguucgucccagacgacucgcccga

SEQ ID NO: 2537 - RNA, 51 nt, Artificial Sequence
  Description of Artificial Sequence: Synthetic oligonucleotide
gggaggacgaugcgguccuguagucuguucguacccagacgacucgcccga

SEQ ID NO: 2538 - RNA, 51 nt, Artificial Sequence
  Description of Artificial Sequence: Synthetic oligonucleotide
gggaggacgaugcgguuuggggucuucccgugccccagacgacucgcccga

SEQ ID NO: 2539 - RNA, 50 nt, Artificial Sequence
  Description of Artificial Sequence: Synthetic oligonucleotide
gggaggacgaugcgggacuguacggggcucugugcagacgacucgcccga

SEQ ID NO: 2540 - RNA, 51 nt, Artificial Sequence
  Description of Artificial Sequence: Synthetic oligonucleotide
gggaggacgaugcggcccugucgucuguucuuccccagacgacucgcccga

SEQ ID NO: 2541 - RNA, 51 nt, Artificial Sequence
  Description of Artificial Sequence: Synthetic oligonucleotide
gggaggacgaugcgguuugggguuuuccugcgccccagacgacucgcccga

SEQ ID NO: 2542 - RNA, 51 nt, Artificial Sequence
  Description of Artificial Sequence: Synthetic oligonucleotide
gggaggacgaugcggcgacuccucuguaugcuccccagacgacucgcccga

SEQ ID NO: 2543 - RNA, 52 nt, Artificial Sequence
  Description of Artificial Sequence: Synthetic oligonucleotide
gggaggacgaugcgggucccgucgucuguucguccccagacgacucgcccga

SEQ ID NO: 2544 - RNA, 51 nt, Artificial Sequence
  Description of Artificial Sequence: Synthetic oligonucleotide
gggaggacgaugcgggucagucguuugcucguccccagacgacucgcccga

SEQ ID NO: 2545 - RNA, 52 nt, Artificial Sequence
  Description of Artificial Sequence: Synthetic oligonucleotide
gggaggacgaugcggguccugucgccuguucguccccagacgacucgcccga

SEQ ID NO: 2546 - RNA, 52 nt, Artificial Sequence
  Description of Artificial Sequence: Synthetic oligonucleotide
gggaggacgaugcggguccugucgucuguucgcccccagacgacucgcccga

SEQ ID NO: 2547 - RNA, 51 nt, Artificial Sequence
  Description of Artificial Sequence: Synthetic oligonucleotide
gggaggacgaugcggucgauucuucugcugcuccccagacgacucgcccga

SEQ ID NO: 2548 - RNA, 51 nt, Artificial Sequence
  Description of Artificial Sequence: Synthetic oligonucleotide
gggaggacgaugcggugagucguucucuucguccccagacgacucgcccga

SEQ ID NO: 2549 - RNA, 50 nt, Artificial Sequence
  Description of Artificial Sequence: Synthetic oligonucleotide
gggaggacgaugcgguccugucucuguucguccccagacgacucgcccga

SEQ ID NO: 2550 - RNA, 51 nt, Artificial Sequence
  Description of Artificial Sequence: Synthetic oligonucleotide
gggaggacgaugcgguuugggguuuucccgugccgcagacgacucgcccga

SEQ ID NO: 2551 - RNA, 51 nt, Artificial Sequence
  Description of Artificial Sequence: Synthetic oligonucleotide
gggaggacgaugcgggccuuucgucuauuccuccccagacgacucgcccga

SEQ ID NO: 2552 - RNA, 51 nt, Artificial Sequence
  Description of Artificial Sequence: Synthetic oligonucleotide
gggaggacgaugcggcccugucgucugcucguccccagacgacucgcccga

SEQ ID NO: 2553 - RNA, 51 nt, Artificial Sequence
  Description of Artificial Sequence: Synthetic oligonucleotide
gggaggacgaugcggcccugucgucuguuccuccccagacgacucgcccga

SEQ ID NO: 2554 - RNA, 51 nt, Artificial Sequence
  Description of Artificial Sequence: Synthetic oligonucleotide
gggaggacgaugcggucuugucgucugcucguccccagacgacucgcccga

SEQ ID NO: 2555 - RNA, 51 nt, Artificial Sequence
  Description of Artificial Sequence: Synthetic oligonucleotide
gggaggacgaugcggcgaccucgucugaaccuccccagacgacucgcccga

SEQ ID NO: 2556 - RNA, 51 nt, Artificial Sequence
  Description of Artificial Sequence: Synthetic oligonucleotide
gggaggacgaugcgggcccuucgucuguucuuccccagacgacucgcccga

SEQ ID NO: 2557 - RNA, 51 nt, Artificial Sequence
  Description of Artificial Sequence: Synthetic oligonucleotide
gggaggacgaugcgguccugucgucuuugcguccccagacgacucgcccga

SEQ ID NO: 2558 - RNA, 51 nt, Artificial Sequence
  Description of Artificial Sequence: Synthetic oligonucleotide
gggaggacgaugcggugcguuucguuugcccuccccagacgacucgcccga

SEQ ID NO: 2559 - RNA, 51 nt, Artificial Sequence
  Description of Artificial Sequence: Synthetic oligonucleotide
gggaggacgaugcgguccugucguauguucguacccagacgacucgcccga

SEQ ID NO: 2560 - RNA, 50 nt, Artificial Sequence
  Description of Artificial Sequence: Synthetic oligonucleotide
gggaggacgaugcgguccugucguuguucguccccagacgacucgcccga

SEQ ID NO: 2561 - RNA, 50 nt, Artificial Sequence
  Description of Artificial Sequence: Synthetic oligonucleotide
gggaggacgaugcgguuugggguuuucccgugcccagacgacucgcccga

SEQ ID NO: 2562 - RNA, 51 nt, Artificial Sequence
  Description of Artificial Sequence: Synthetic oligonucleotide
gggaggacgaugcggaccugucgucuguucguacccagacgacucgcccga

SEQ ID NO: 2563 - RNA, 51 nt, Artificial Sequence
  Description of Artificial Sequence: Synthetic oligonucleotide
gggaggacgaugcgggcccuucgucuaugccuccccagacgacucgcccga

SEQ ID NO: 2564 - RNA, 51 nt, Artificial Sequence
  Description of Artificial Sequence: Synthetic oligonucleotide
gggaggacgaugcggucaugucgucuguucguacccagacgacucgcccga

SEQ ID NO: 2565 - RNA, 51 nt, Artificial Sequence
  Description of Artificial Sequence: Synthetic oligonucleotide
gggaggacgaugcgguccugucgucuguucguaaccagacgacucgcccga

SEQ ID NO: 2566 - RNA, 48 nt, Artificial Sequence
  Description of Artificial Sequence: Synthetic oligonucleotide
gggaggacgaugcgguccugucgucuuguccccagacgacucgcccga

SEQ ID NO: 2567 - RNA, 51 nt, Artificial Sequence
  Description of Artificial Sequence: Synthetic oligonucleotide
gggaggacgaugcggucuugucgucuguucguuuccagacgacucgcccga

SEQ ID NO: 2568 - RNA, 51 nt, Artificial Sequence
  Description of Artificial Sequence: Synthetic oligonucleotide
gggaggacgaugcggcuugggguuuucccgugccccagacgacucgcccga

SEQ ID NO: 2569 - RNA, 52 nt, Artificial Sequence
  Description of Artificial Sequence: Synthetic oligonucleotide
gggaggacgaugcggguccugucgucuauucguccccagacgacucgcccga

SEQ ID NO: 2570 - RNA, 51 nt, Artificial Sequence
  Description of Artificial Sequence: Synthetic oligonucleotide
gggaggacgaugcggguuucucgucugcugcuccccagacgacucgcccga

SEQ ID NO: 2571 - RNA, 51 nt, Artificial Sequence
  Description of Artificial Sequence: Synthetic oligonucleotide
gggaggacgaugcgguuugggguuuucccgcgccccagacgacucgcccga

SEQ ID NO: 2572 - RNA, 51 nt, Artificial Sequence
  Description of Artificial Sequence: Synthetic oligonucleotide
gggaggacgaugcggcccugucgucuguucgcccccagacgacucgcccga

SEQ ID NO: 2573 - RNA, 51 nt, Artificial Sequence
  Description of Artificial Sequence: Synthetic oligonucleotide
gggaggacgaugcgggccuucgucuugugccuccccagacgacucgcccga

SEQ ID NO: 2574 - RNA, 51 nt, Artificial Sequence
  Description of Artificial Sequence: Synthetic oligonucleotide
gggaggacgaugcgggguuucgucuguuuccuccccagacgacucgcccga

SEQ ID NO: 2575 - RNA, 51 nt, Artificial Sequence
  Description of Artificial Sequence: Synthetic oligonucleotide
gggaggacgaugcgguccugucgucuguuagucaccagacgacucgcccga

SEQ ID NO: 2576 - RNA, 51 nt, Artificial Sequence
  Description of Artificial Sequence: Synthetic oligonucleotide
gggaggacgaugcggagcguuucgucugcccuccccagacgacucgcccga

SEQ ID NO: 2577 - RNA, 52 nt, Artificial Sequence
  Description of Artificial Sequence: Synthetic oligonucleotide
gggaggacgaugcggguccugucgucuguucguuuccagacgacucgcccga

SEQ ID NO: 2578 - RNA, 51 nt, Artificial Sequence
  Description of Artificial Sequence: Synthetic oligonucleotide
gggaggacgaugcggucucgucgucuguucguccccagacgacucgcccga

SEQ ID NO: 2579 - RNA, 51 nt, Artificial Sequence
  Description of Artificial Sequence: Synthetic oligonucleotide
gggaggacgaugcggcguuuccucuggcucguccccagacgacucgcccga

SEQ ID NO: 2580 - RNA, 51 nt, Artificial Sequence
  Description of Artificial Sequence: Synthetic oligonucleotide
gggaggacgaugcgggccugucgucuguucguccccagacgacucgcccga

SEQ ID NO: 2581 - RNA, 51 nt, Artificial Sequence
  Description of Artificial Sequence: Synthetic oligonucleotide
gggaggacgaugcggucuugucgucuuuucguccccagacgacucgcccga

SEQ ID NO: 2582 - RNA, 51 nt, Artificial Sequence
  Description of Artificial Sequence: Synthetic oligonucleotide
gggaggacgaugcggguucauguuuaccuuucguccagacgacucgcccga

SEQ ID NO: 2583 - RNA, 51 nt, Artificial Sequence
  Description of Artificial Sequence: Synthetic oligonucleotide
gggaggacgaugcggcccugucgccuguucguccccagacgacucgcccga

SEQ ID NO: 2584 - RNA, 51 nt, Artificial Sequence
  Description of Artificial Sequence: Synthetic oligonucleotide
gggaggacgaugcggcgaauccucugcugucuccccagacgacucgcccga

SEQ ID NO: 2585 - RNA, 51 nt, Artificial Sequence
  Description of Artificial Sequence: Synthetic oligonucleotide
gggaggacgaugcggcgacucuucugcaaccuccccagacgacucgcccga

SEQ ID NO: 2586 - RNA, 51 nt, Artificial Sequence
  Description of Artificial Sequence: Synthetic oligonucleotide
gggaggacgaugcgguccuggcucgucguuguccccagacgacucgcccga

SEQ ID NO: 2587 - RNA, 48 nt, Artificial Sequence
  Description of Artificial Sequence: Synthetic oligonucleotide
gggaggacgaugcgguccuggcuuguuguccccagacgacucgcccga

SEQ ID NO: 2588 - RNA, 51 nt, Artificial Sequence
  Description of Artificial Sequence: Synthetic oligonucleotide
gggaggacgaugcgggcuuuucgucucugcguccccagacgacucgcccga

SEQ ID NO: 2589 - RNA, 52 nt, Artificial Sequence
  Description of Artificial Sequence: Synthetic oligonucleotide
gggaggacgaugcggguccugucgucuguccguccccagacgacucgcccga

SEQ ID NO: 2590 - RNA, 50 nt, Artificial Sequence
  Description of Artificial Sequence: Synthetic oligonucleotide
gggaggacgaugcggucuugucgucuguucgucccagacgacucgcccga

SEQ ID NO: 2591 - RNA, 51 nt, Artificial Sequence
  Description of Artificial Sequence: Synthetic oligonucleotide
gggaggacgaugcgguuuggggauuuccugcgccccagacgacucgcccga

SEQ ID NO: 2592 - RNA, 51 nt, Artificial Sequence
  Description of Artificial Sequence: Synthetic oligonucleotide
gggaggacgaugcgggaucaugcuuuccuuucguccagacgacucgcccga

SEQ ID NO: 2593 - RNA, 51 nt, Artificial Sequence
  Description of Artificial Sequence: Synthetic oligonucleotide
gggaggacgaugcggcccugucgucuguccguccccagacgacucgcccga

SEQ ID NO: 2594 - RNA, 51 nt, Artificial Sequence
  Description of Artificial Sequence: Synthetic oligonucleotide
gggaggacgaugcggccuuucgucugacugcuccccagacgacucgcccga

SEQ ID NO: 2595 - RNA, 51 nt, Artificial Sequence
  Description of Artificial Sequence: Synthetic oligonucleotide
gggaggacgaugcggcgucucgucuuuucccuccccagacgacucgcccga

SEQ ID NO: 2596 - RNA, 52 nt, Artificial Sequence
  Description of Artificial Sequence: Synthetic oligonucleotide
gggaggacgaugcggguccugucgucucuucguccccagacgacucgcccga

SEQ ID NO: 2597 - RNA, 51 nt, Artificial Sequence
  Description of Artificial Sequence: Synthetic oligonucleotide
gggaggacgaugcggucggucgucucuuucguccccagacgacucgcccga

SEQ ID NO: 2598 - RNA, 51 nt, Artificial Sequence
  Description of Artificial Sequence: Synthetic oligonucleotide
gggaggacgaugcggucuucuggguuuggccgccccagacgacucgcccga

SEQ ID NO: 2599 - RNA, 51 nt, Artificial Sequence
  Description of Artificial Sequence: Synthetic oligonucleotide
gggaggacgaugcggguugggguuuucccgugccccagacgacucgcccga

SEQ ID NO: 2600 - RNA, 51 nt, Artificial Sequence
  Description of Artificial Sequence: Synthetic oligonucleotide
gggaggacgaugcggccagucgucuauuucguccccagacgacucgcccga

SEQ ID NO: 2601 - RNA, 51 nt, Artificial Sequence
  Description of Artificial Sequence: Synthetic oligonucleotide
gggaggacgaugcggcgaucguucugcuaccuccccagacgacucgcccga

SEQ ID NO: 2602 - RNA, 51 nt, Artificial Sequence
  Description of Artificial Sequence: Synthetic oligonucleotide
gggaggacgaugcgggguuucgucugacucguccccagacgacucgcccga

SEQ ID NO: 2603 - RNA, 51 nt, Artificial Sequence
  Description of Artificial Sequence: Synthetic oligonucleotide
gggaggacgaugcgggucgacucguuugcgcuccccagacgacucgcccga

SEQ ID NO: 2604 - RNA, 51 nt, Artificial Sequence
  Description of Artificial Sequence: Synthetic oligonucleotide
gggaggacgaugcgguccugucgucuguuaguccacagacgacucgcccga

SEQ ID NO: 2605 - RNA, 53 nt, Artificial Sequence
  Description of Artificial Sequence: Synthetic oligonucleotide
gggaggacgaugcgguccugucgucuguuuucguccccagacgacucgcccga

SEQ ID NO: 2606 - RNA, 51 nt, Artificial Sequence
  Description of Artificial Sequence: Synthetic oligonucleotide
gggaggacgaugcgguuugggguucucccgugccccagacgacucgcccga

SEQ ID NO: 2607 - RNA, 51 nt, Artificial Sequence
  Description of Artificial Sequence: Synthetic oligonucleotide
gggaggacgaugcgguuugggguuuuuccgugccccagacgacucgcccga

SEQ ID NO: 2608 - RNA, 51 nt, Artificial Sequence
  Description of Artificial Sequence: Synthetic oligonucleotide
gggaggacgaugcggccuucgucugguuucguccccagacgacucgcccga

SEQ ID NO: 2609 - RNA, 52 nt, Artificial Sequence
  Description of Artificial Sequence: Synthetic oligonucleotide
gggaggacgaugcggguccugccgucuguucguccccagacgacucgcccga

SEQ ID NO: 2610 - RNA, 52 nt, Artificial Sequence
  Description of Artificial Sequence: Synthetic oligonucleotide
gggaggacgaugcggguccugucguccguucguccccagacgacucgcccga

SEQ ID NO: 2611 - RNA, 49 nt, Artificial Sequence
  Description of Artificial Sequence: Synthetic oligonucleotide
gggaggacgaugcgguccugucgucucuguccccagacgacucgcccga

SEQ ID NO: 2612 - RNA, 49 nt, Artificial Sequence
  Description of Artificial Sequence: Synthetic oligonucleotide
gggaggacgaugcgguugucgucuguucguccccagacgacucgcccga

SEQ ID NO: 2613 - RNA, 51 nt, Artificial Sequence
  Description of Artificial Sequence: Synthetic oligonucleotide
gggaggacgaugcgguuuggggauuuccucggccccagacgacucgcccga

SEQ ID NO: 2614 - RNA, 51 nt, Artificial Sequence
  Description of Artificial Sequence: Synthetic oligonucleotide
gggaggacgaugcgggccuucuucuggagccuccccagacgacucgcccga

SEQ ID NO: 2615 - RNA, 52 nt, Artificial Sequence
  Description of Artificial Sequence: Synthetic oligonucleotide
gggaggacgaugcggguccugucguuuguucguccccagacgacucgcccga

SEQ ID NO: 2616 - RNA, 51 nt, Artificial Sequence
  Description of Artificial Sequence: Synthetic oligonucleotide
gggaggacgaugcgguccugucguauguuaguccccagacgacucgcccga

SEQ ID NO: 2617 - RNA, 51 nt, Artificial Sequence
  Description of Artificial Sequence: Synthetic oligonucleotide
gggaggacgaugcggucgguucguucugcgcuccccagacgacucgcccga

SEQ ID NO: 2618 - RNA, 50 nt, Artificial Sequence
  Description of Artificial Sequence: Synthetic oligonucleotide
gggaggacgaugcgguuugggguuuucccugccccagacgacucgcccga

SEQ ID NO: 2619 - RNA, 51 nt, Artificial Sequence
  Description of Artificial Sequence: Synthetic oligonucleotide
gggaggacgaugcggccgacucgucugcuacuccccagacgacucgcccga

SEQ ID NO: 2620 - RNA, 51 nt, Artificial Sequence
  Description of Artificial Sequence: Synthetic oligonucleotide
gggaggacgaugcggcgcuuuucgucugaccuccccagacgacucgcccga

SEQ ID NO: 2621 - RNA, 51 nt, Artificial Sequence
  Description of Artificial Sequence: Synthetic oligonucleotide
gggaggacgaugcgggccauucguuuguucguccccagacgacucgcccga

SEQ ID NO: 2622 - RNA, 51 nt, Artificial Sequence
  Description of Artificial Sequence: Synthetic oligonucleotide
gggaggacgaugcgggcccuucguucugaacuccccagacgacucgcccga

SEQ ID NO: 2623 - RNA, 51 nt, Artificial Sequence
  Description of Artificial Sequence: Synthetic oligonucleotide
gggaggacgaugcgggccuguccucuguucguccccagacgacucgcccga

SEQ ID NO: 2624 - RNA, 51 nt, Artificial Sequence
  Description of Artificial Sequence: Synthetic oligonucleotide
gggaggacgaugcgggcguuuccucuguucguucccagacgacucgcccga

SEQ ID NO: 2625 - RNA, 51 nt, Artificial Sequence
  Description of Artificial Sequence: Synthetic oligonucleotide
gggaggacgaugcgggcuuuucguucugaccuccccagacgacucgcccga

SEQ ID NO: 2626 - RNA, 51 nt, Artificial Sequence
  Description of Artificial Sequence: Synthetic oligonucleotide
gggaggacgaugcgggucaguucgucugcacuccccagacgacucgcccga

SEQ ID NO: 2627 - RNA, 51 nt, Artificial Sequence
  Description of Artificial Sequence: Synthetic oligonucleotide
gggaggacgaugcggguccugucgucuguuguccccagacgacucgcccga

SEQ ID NO: 2628 - RNA, 51 nt, Artificial Sequence
  Description of Artificial Sequence: Synthetic oligonucleotide
gggaggacgaugcgguccuguaguauguucguccccagacgacucgcccga

SEQ ID NO: 2629 - RNA, 51 nt, Artificial Sequence
  Description of Artificial Sequence: Synthetic oligonucleotide
gggaggacgaugcggucguuugggauuucccgccccagacgacucgcccga

SEQ ID NO: 2630 - RNA, 51 nt, Artificial Sequence
  Description of Artificial Sequence: Synthetic oligonucleotide
gggaggacgaugcggucuugucgucuguuuguccccagacgacucgcccga

SEQ ID NO: 2631 - RNA, 51 nt, Artificial Sequence
  Description of Artificial Sequence: Synthetic oligonucleotide
gggaggacgaugcggucuuguucgucugcacuccccagacgacucgcccga

SEQ ID NO: 2632 - RNA, 51 nt, Artificial Sequence
  Description of Artificial Sequence: Synthetic oligonucleotide
gggaggacgaugcgguuugggguuauucccugccccagacgacucgcccga

SEQ ID NO: 2633 - RNA, 51 nt, Artificial Sequence
  Description of Artificial Sequence: Synthetic oligonucleotide
gggaggacgaugcggccccgucgucuguucguccccagacgacucgcccga

SEQ ID NO: 2634 - RNA, 51 nt, Artificial Sequence
  Description of Artificial Sequence: Synthetic oligonucleotide
gggaggacgaugcggcccugucaucuguucguccccagacgacucgcccga

SEQ ID NO: 2635 - RNA, 51 nt, Artificial Sequence
  Description of Artificial Sequence: Synthetic oligonucleotide
gggaggacgaugcggccgagauccucuguacuccccagacgacucgcccga

SEQ ID NO: 2636 - RNA, 51 nt, Artificial Sequence
  Description of Artificial Sequence: Synthetic oligonucleotide
gggaggacgaugcggccuucgucuggauucguccccagacgacucgcccga

SEQ ID NO: 2637 - RNA, 51 nt, Artificial Sequence
  Description of Artificial Sequence: Synthetic oligonucleotide
gggaggacgaugcggcgugucucgucugcacuccccagacgacucgcccga

SEQ ID NO: 2638 - RNA, 51 nt, Artificial Sequence
  Description of Artificial Sequence: Synthetic oligonucleotide
gggaggacgaugcggcguuucgucugucaccuccccagacgacucgcccga

SEQ ID NO: 2639 - RNA, 51 nt, Artificial Sequence
  Description of Artificial Sequence: Synthetic oligonucleotide
gggaggacgaugcgggccuucucgucugacucccccagacgacucgcccga

SEQ ID NO: 2640 - RNA, 51 nt, Artificial Sequence
  Description of Artificial Sequence: Synthetic oligonucleotide
gggaggacgaugcgggccuucucgucugauccccccagacgacucgcccga

SEQ ID NO: 2641 - RNA, 48 nt, Artificial Sequence
  Description of Artificial Sequence: Synthetic oligonucleotide
gggaggacgaugcggguccugucgucuguccccagacgacucgcccga

SEQ ID NO: 2642 - RNA, 52 nt, Artificial Sequence
  Description of Artificial Sequence: Synthetic oligonucleotide
gggaggacgaugcggguccugucgucuguucauccccagacgacucgcccga

SEQ ID NO: 2643 - RNA, 51 nt, Artificial Sequence
  Description of Artificial Sequence: Synthetic oligonucleotide
gggaggacgaugcgguacugucgucuguucguacccagacgacucgcccga

SEQ ID NO: 2644 - RNA, 51 nt, Artificial Sequence
  Description of Artificial Sequence: Synthetic oligonucleotide
gggaggacgaugcggucaugucgucuguucguccacagacgacucgcccga

SEQ ID NO: 2645 - RNA, 51 nt, Artificial Sequence
  Description of Artificial Sequence: Synthetic oligonucleotide
gggaggacgaugcgguccuggcuugucguuguuuccagacgacucgcccga

SEQ ID NO: 2646 - RNA, 50 nt, Artificial Sequence
  Description of Artificial Sequence: Synthetic oligonucleotide
gggaggacgaugcgguccugucgucuaucguccccagacgacucgcccga

SEQ ID NO: 2647 - RNA, 51 nt, Artificial Sequence
  Description of Artificial Sequence: Synthetic oligonucleotide
gggaggacgaugcgguccugucgucugcucguucccagacgacucgcccga

SEQ ID NO: 2648 - RNA, 50 nt, Artificial Sequence
  Description of Artificial Sequence: Synthetic oligonucleotide
gggaggacgaugcgguccugucgucuguucuucccagacgacucgcccga

SEQ ID NO: 2649 - RNA, 51 nt, Artificial Sequence
  Description of Artificial Sequence: Synthetic oligonucleotide
gggaggacgaugcgguuuugucgucuguucguccccagacgacucgcccga

SEQ ID NO: 2650 - RNA, 51 nt, Artificial Sequence
  Description of Artificial Sequence: Synthetic oligonucleotide
gggaggacgaugcggcccugucguccguucguccccagacgacucgcccga

SEQ ID NO: 2651 - RNA, 51 nt, Artificial Sequence
  Description of Artificial Sequence: Synthetic oligonucleotide
gggaggacgaugcggcccugucgucuguucgucuccagacgacucgcccga

SEQ ID NO: 2652 - RNA, 51 nt, Artificial Sequence
  Description of Artificial Sequence: Synthetic oligonucleotide
gggaggacgaugcggcguauuucgucugcgcuccccagacgacucgcccga

SEQ ID NO: 2653 - RNA, 51 nt, Artificial Sequence
  Description of Artificial Sequence: Synthetic oligonucleotide
gggaggacgaugcggcgucuuucgucugugguccccagacgacucgcccga

SEQ ID NO: 2654 - RNA, 51 nt, Artificial Sequence
  Description of Artificial Sequence: Synthetic oligonucleotide
gggaggacgaugcggcguuuuucgucugagcuccccagacgacucgcccga

SEQ ID NO: 2655 - RNA, 51 nt, Artificial Sequence
  Description of Artificial Sequence: Synthetic oligonucleotide
gggaggacgaugcgggcguuucguuuccucguccccagacgacucgcccga

SEQ ID NO: 2656 - RNA, 52 nt, Artificial Sequence
  Description of Artificial Sequence: Synthetic oligonucleotide
gggaggacgaugcggguccuguugucuguucguccccagacgacucgcccga

SEQ ID NO: 2657 - RNA, 51 nt, Artificial Sequence
  Description of Artificial Sequence: Synthetic oligonucleotide
gggaggacgaugcgguccuguagucuguuaguccccagacgacucgcccga

SEQ ID NO: 2658 - RNA, 51 nt, Artificial Sequence
  Description of Artificial Sequence: Synthetic oligonucleotide
gggaggacgaugcggucguugucuucugcgcuccccagacgacucgcccga

SEQ ID NO: 2659 - RNA, 54 nt, Artificial Sequence
  Description of Artificial Sequence: Synthetic oligonucleotide
gggaggacgaugcgguuugggguuuuuuucccgugccccagacgacucgcccga

SEQ ID NO: 2660 - RNA, 51 nt, Artificial Sequence
  Description of Artificial Sequence: Synthetic oligonucleotide
gggaggacgaugcggcgucacucgucuguacuccccagacgacucgcccga

SEQ ID NO: 2661 - RNA, 52 nt, Artificial Sequence
  Description of Artificial Sequence: Synthetic oligonucleotide
gggaggacgaugcggguccugucgucuguucuuccccagacgacucgcccga

SEQ ID NO: 2662 - RNA, 51 nt, Artificial Sequence
  Description of Artificial Sequence: Synthetic oligonucleotide
gggaggacgaugcgguccuggcuugucguuuuccccagacgacucgcccga

SEQ ID NO: 2663 - RNA, 51 nt, Artificial Sequence
  Description of Artificial Sequence: Synthetic oligonucleotide
gggaggacgaugcgguccugucguauguucguccacagacgacucgcccga

SEQ ID NO: 2664 - RNA, 52 nt, Artificial Sequence
  Description of Artificial Sequence: Synthetic oligonucleotide
gggaggacgaugcgguccugucgucuguucccuccccagacgacucgcccga

SEQ ID NO: 2665 - RNA, 51 nt, Artificial Sequence
  Description of Artificial Sequence: Synthetic oligonucleotide
gggaggacgaugcggugugaucgucugcaccuccccagacgacucgcccga

SEQ ID NO: 2666 - RNA, 51 nt, Artificial Sequence
  Description of Artificial Sequence: Synthetic oligonucleotide
gggaggacgaugcggccagucguucugucccuccccagacgacucgcccga

SEQ ID NO: 2667 - RNA, 50 nt, Artificial Sequence
  Description of Artificial Sequence: Synthetic oligonucleotide
gggaggacgaugcgguccuggcuugucguugucccagacgacucgcccga

SEQ ID NO: 2668 - RNA, 51 nt, Artificial Sequence
  Description of Artificial Sequence: Synthetic oligonucleotide
gggaggacgaugcggcccugucgucuguucauccccagacgacucgcccga

SEQ ID NO: 2669 - RNA, 51 nt, Artificial Sequence
  Description of Artificial Sequence: Synthetic oligonucleotide
gggaggacgaugcggccgaucguucugugccuccccagacgacucgcccga

SEQ ID NO: 2670 - RNA, 51 nt, Artificial Sequence
  Description of Artificial Sequence: Synthetic oligonucleotide
gggaggacgaugcggcuacacucaaaugagggccgcagacgacucgcccga

SEQ ID NO: 2671 - RNA, 51 nt, Artificial Sequence
  Description of Artificial Sequence: Synthetic oligonucleotide
gggaggacgaugcggcucugucgucuguucguccccagacgacucgcccga

SEQ ID NO: 2672 - RNA, 52 nt, Artificial Sequence
  Description of Artificial Sequence: Synthetic oligonucleotide
gggaggacgaugcgggccuucucgucuguucguccccagacgacucgcccga

SEQ ID NO: 2673 - RNA, 51 nt, Artificial Sequence
  Description of Artificial Sequence: Synthetic oligonucleotide
gggaggacgaugcgguccuggcuugucgcuguccccagacgacucgcccga

SEQ ID NO: 2674 - RNA, 50 nt, Artificial Sequence
  Description of Artificial Sequence: Synthetic oligonucleotide
gggaggacgaugcgguccuggcuugucguuuccccagacgacucgcccga

SEQ ID NO: 2675 - RNA, 51 nt, Artificial Sequence
  Description of Artificial Sequence: Synthetic oligonucleotide
gggaggacgaugcgguccuguagucuguucguccacagacgacucgcccga

SEQ ID NO: 2676 - RNA, 51 nt, Artificial Sequence
  Description of Artificial Sequence: Synthetic oligonucleotide
gggaggacgaugcgguccugucgucuguuuguucccagacgacucgcccga

SEQ ID NO: 2677 - RNA, 51 nt, Artificial Sequence
  Description of Artificial Sequence: Synthetic oligonucleotide
gggaggacgaugcggugacucgucugcgccuuccccagacgacucgcccga

SEQ ID NO: 2678 - RNA, 51 nt, Artificial Sequence
  Description of Artificial Sequence: Synthetic oligonucleotide
gggaggacgaugcggccagucgucuuguucguccccagacgacucgcccga

SEQ ID NO: 2679 - RNA, 51 nt, Artificial Sequence
  Description of Artificial Sequence: Synthetic oligonucleotide
gggaggacgaugcggccagucuucuguuaccuccccagacgacucgcccga

SEQ ID NO: 2680 - RNA, 51 nt, Artificial Sequence
  Description of Artificial Sequence: Synthetic oligonucleotide
gggaggacgaugcggcguuuccucugguucguucccagacgacucgcccga

SEQ ID NO: 2681 - RNA, 49 nt, Artificial Sequence
  Description of Artificial Sequence: Synthetic oligonucleotide
gggaggacgaugcgguccuggcuugucguuccccagacgacucgcccga

SEQ ID NO: 2682 - RNA, 51 nt, Artificial Sequence
  Description of Artificial Sequence: Synthetic oligonucleotide
gggaggacgaugcgguccuggcuugucguuguacccagacgacucgcccga

SEQ ID NO: 2683 - RNA, 51 nt, Artificial Sequence
  Description of Artificial Sequence: Synthetic oligonucleotide
gggaggacgaugcgguccuggcuuguuguuguccccagacgacucgcccga

SEQ ID NO: 2684 - RNA, 51 nt, Artificial Sequence
  Description of Artificial Sequence: Synthetic oligonucleotide
gggaggacgaugcggucgauucgucuccgcguccccagacgacucgcccga

SEQ ID NO: 2685 - RNA, 51 nt, Artificial Sequence
  Description of Artificial Sequence: Synthetic oligonucleotide
gggaggacgaugcgguggguccucuguugccuccccagacgacucgcccga

SEQ ID NO: 2686 - RNA, 51 nt, Artificial Sequence
  Description of Artificial Sequence: Synthetic oligonucleotide
gggaggacgaugcgguuuggggguuucccgugccccagacgacucgcccga

SEQ ID NO: 2687 - RNA, 51 nt, Artificial Sequence
  Description of Artificial Sequence: Synthetic oligonucleotide
gggaggacgaugcgguuugggguuuucucgugccccagacgacucgcccga

SEQ ID NO: 2688 - RNA, 51 nt, Artificial Sequence
  Description of Artificial Sequence: Synthetic oligonucleotide
gggaggacgaugcggcccugccgucuguucguccccagacgacucgcccga

SEQ ID NO: 2689 - RNA, 51 nt, Artificial Sequence
  Description of Artificial Sequence: Synthetic oligonucleotide
gggaggacgaugcggcgacucgugcuguucuuccccagacgacucgcccga

SEQ ID NO: 2690 - RNA, 51 nt, Artificial Sequence
  Description of Artificial Sequence: Synthetic oligonucleotide
gggaggacgaugcggcgccucgucuguuuccuccccagacgacucgcccga

SEQ ID NO: 2691 - RNA, 51 nt, Artificial Sequence
  Description of Artificial Sequence: Synthetic oligonucleotide
gggaggacgaugcgggaguuucgucugagccuccccagacgacucgcccga

SEQ ID NO: 2692 - RNA, 51 nt, Artificial Sequence
  Description of Artificial Sequence: Synthetic oligonucleotide
gggaggacgaugcgggucaaucgucugcgccuccccagacgacucgcccga

SEQ ID NO: 2693 - RNA, 52 nt, Artificial Sequence
  Description of Artificial Sequence: Synthetic oligonucleotide
gggaggacgaugcggguccugucgucuguucguccucagacgacucgcccga

SEQ ID NO: 2694 - RNA, 51 nt, Artificial Sequence
  Description of Artificial Sequence: Synthetic oligonucleotide
gggaggacgaugcgggugucucgucugucacuccccagacgacucgcccga

SEQ ID NO: 2695 - RNA, 52 nt, Artificial Sequence
  Description of Artificial Sequence: Synthetic oligonucleotide
gggaggacgaugcggguguuuccucugguucguccccagacgacucgcccga

SEQ ID NO: 2696 - RNA, 51 nt, Artificial Sequence
  Description of Artificial Sequence: Synthetic oligonucleotide
gggaggacgaugcgguccuggcuugucguugucuccagacgacucgcccga

SEQ ID NO: 2697 - RNA, 51 nt, Artificial Sequence
  Description of Artificial Sequence: Synthetic oligonucleotide
gggaggacgaugcgguccuguagucuguucgucaccagacgacucgcccga

SEQ ID NO: 2698 - RNA, 51 nt, Artificial Sequence
  Description of Artificial Sequence: Synthetic oligonucleotide
gggaggacgaugcgguccugucgucuguucgucaacagacgacucgcccga

SEQ ID NO: 2699 - RNA, 51 nt, Artificial Sequence
  Description of Artificial Sequence: Synthetic oligonucleotide
gggaggacgaugcgguccugucgucuguuucuccccagacgacucgcccga

SEQ ID NO: 2700 - RNA, 52 nt, Artificial Sequence
  Description of Artificial Sequence: Synthetic oligonucleotide
gggaggacgaugcggauccugucgucuguucguccccagacgacucgcccga

SEQ ID NO: 2701 - RNA, 51 nt, Artificial Sequence
  Description of Artificial Sequence: Synthetic oligonucleotide
gggaggacgaugcggcgacuccucugcugcuuccccagacgacucgcccga

SEQ ID NO: 2702 - RNA, 51 nt, Artificial Sequence
  Description of Artificial Sequence: Synthetic oligonucleotide
gggaggacgaugcgggcacucguucugacccuccccagacgacucgcccga

SEQ ID NO: 2703 - RNA, 52 nt, Artificial Sequence
  Description of Artificial Sequence: Synthetic oligonucleotide
gggaggacgaugcggguccugucgucuguuccuccccagacgacucgcccga

SEQ ID NO: 2704 - RNA, 52 nt, Artificial Sequence
  Description of Artificial Sequence: Synthetic oligonucleotide
gggaggacgaugcggguccugucgucuuuucguccccagacgacucgcccga

SEQ ID NO: 2705 - RNA, 50 nt, Artificial Sequence
  Description of Artificial Sequence: Synthetic oligonucleotide
gggaggacgaugcgguccuggcugucguuguccccagacgacucgcccga

SEQ ID NO: 2706 - RNA, 52 nt, Artificial Sequence
  Description of Artificial Sequence: Synthetic oligonucleotide
gggaggacgaugcgguccugucgucugauucguccccagacgacucgcccga

SEQ ID NO: 2707 - RNA, 50 nt, Artificial Sequence
  Description of Artificial Sequence: Synthetic oligonucleotide
gggaggacgaugcgguccugucgucugcucgucccagacgacucgcccga

SEQ ID NO: 2708 - RNA, 49 nt, Artificial Sequence
  Description of Artificial Sequence: Synthetic oligonucleotide
gggaggacgaugcgguccugucgucuguccccccagacgacucgcccga

SEQ ID NO: 2709 - RNA, 52 nt, Artificial Sequence
  Description of Artificial Sequence: Synthetic oligonucleotide
gggaggacgaugcgguccugucguucuguucguccccagacgacucgcccga

SEQ ID NO: 2710 - RNA, 51 nt, Artificial Sequence
  Description of Artificial Sequence: Synthetic oligonucleotide
gggaggacgaugcggucugggguuuucccgugccccagacgacucgcccga

SEQ ID NO: 2711 - RNA, 51 nt, Artificial Sequence
  Description of Artificial Sequence: Synthetic oligonucleotide
gggaggacgaugcgguuugggguuuucccaugccccagacgacucgcccga

SEQ ID NO: 2712 - RNA, 51 nt, Artificial Sequence
  Description of Artificial Sequence: Synthetic oligonucleotide
gggaggacgaugcgguuugggguuuucccgugacccagacgacucgcccga

SEQ ID NO: 2713 - RNA, 50 nt, Artificial Sequence
  Description of Artificial Sequence: Synthetic oligonucleotide
gggaggacgaugcggcccgucgucuguucguccccagacgacucgcccga

SEQ ID NO: 2714 - RNA, 51 nt, Artificial Sequence
  Description of Artificial Sequence: Synthetic oligonucleotide
gggaggacgaugcggcgacgucuguucuaccuccccagacgacucgcccga

SEQ ID NO: 2715 - RNA, 51 nt, Artificial Sequence
  Description of Artificial Sequence: Synthetic oligonucleotide
gggaggacgaugcggcguuuccucugguucguuuccagacgacucgcccga

SEQ ID NO: 2716 - RNA, 51 nt, Artificial Sequence
  Description of Artificial Sequence: Synthetic oligonucleotide
gggaggacgaugcgggccccucguucuguacuccccagacgacucgcccga

SEQ ID NO: 2717 - RNA, 51 nt, Artificial Sequence
  Description of Artificial Sequence: Synthetic oligonucleotide
gggaggacgaugcgggcgcacucguuugcacuccccagacgacucgcccga

SEQ ID NO: 2718 - RNA, 51 nt, Artificial Sequence
  Description of Artificial Sequence: Synthetic oligonucleotide
gggaggacgaugcgggcuuuucguuugccgcuccccagacgacucgcccga

SEQ ID NO: 2719 - RNA, 52 nt, Artificial Sequence
  Description of Artificial Sequence: Synthetic oligonucleotide
gggaggacgaugcggguccugucgucuguucguacccagacgacucgcccga

SEQ ID NO: 2720 - RNA, 52 nt, Artificial Sequence
  Description of Artificial Sequence: Synthetic oligonucleotide
gggaggacgaugcggguccugucgucuguucgucuccagacgacucgcccga

SEQ ID NO: 2721 - RNA, 51 nt, Artificial Sequence
  Description of Artificial Sequence: Synthetic oligonucleotide
gggaggacgaugcggucaugucgucuguuaguccccagacgacucgcccga

SEQ ID NO: 2722 - RNA, 51 nt, Artificial Sequence
  Description of Artificial Sequence: Synthetic oligonucleotide
gggaggacgaugcgguccagucgaucuguugccgccagacgacucgcccga

SEQ ID NO: 2723 - RNA, 51 nt, Artificial Sequence
  Description of Artificial Sequence: Synthetic oligonucleotide
gggaggacgaugcgguccuggcuugccguuguccccagacgacucgcccga

SEQ ID NO: 2724 - RNA, 50 nt, Artificial Sequence
  Description of Artificial Sequence: Synthetic oligonucleotide
gggaggacgaugcgguccuggcuugucguguccccagacgacucgcccga

SEQ ID NO: 2725 - RNA, 51 nt, Artificial Sequence
  Description of Artificial Sequence: Synthetic oligonucleotide
gggaggacgaugcgguccugucgucugcucguuuccagacgacucgcccga

SEQ ID NO: 2726 - RNA, 50 nt, Artificial Sequence
  Description of Artificial Sequence: Synthetic oligonucleotide
gggaggacgaugcgguccuucgucuguucguccccagacgacucgcccga

SEQ ID NO: 2727 - RNA, 51 nt, Artificial Sequence
  Description of Artificial Sequence: Synthetic oligonucleotide
gggaggacgaugcggcugucuaccuucuacugccccagacgacucgcccga

SEQ ID NO: 2728 - RNA, 51 nt, Artificial Sequence
  Description of Artificial Sequence: Synthetic oligonucleotide
gggaggacgaugcggccauucgucuguugccuccccagacgacucgcccga

SEQ ID NO: 2729 - RNA, 51 nt, Artificial Sequence
  Description of Artificial Sequence: Synthetic oligonucleotide
gggaggacgaugcggcgaucucgucugaaccuccccagacgacucgcccga

SEQ ID NO: 2730 - RNA, 51 nt, Artificial Sequence
  Description of Artificial Sequence: Synthetic oligonucleotide
gggaggacgaugcgggccacucgucuaaucguccccagacgacucgcccga

SEQ ID NO: 2731 - RNA, 53 nt, Artificial Sequence
  Description of Artificial Sequence: Synthetic oligonucleotide
gggaggacgaugcgggccuucucgucuguugucuccccagacgacucgcccga

SEQ ID NO: 2732 - RNA, 51 nt, Artificial Sequence
  Description of Artificial Sequence: Synthetic oligonucleotide
gggaggacgaugcgggcgcuuccucugaaccuccccagacgacucgcccga

SEQ ID NO: 2733 - RNA, 51 nt, Artificial Sequence
  Description of Artificial Sequence: Synthetic oligonucleotide
gggaggacgaugcgggcgcuuccucuguucguccccagacgacucgcccga

SEQ ID NO: 2734 - RNA, 51 nt, Artificial Sequence
  Description of Artificial Sequence: Synthetic oligonucleotide
gggaggacgaugcgggcuucucgucugucccuccccagacgacucgcccga

SEQ ID NO: 2735 - RNA, 51 nt, Artificial Sequence
  Description of Artificial Sequence: Synthetic oligonucleotide
gggaggacgaugcgggcuuuucguacugcgcuccccagacgacucgcccga

SEQ ID NO: 2736 - RNA, 51 nt, Artificial Sequence
  Description of Artificial Sequence: Synthetic oligonucleotide
gggaggacgaugcgguccugucguauguucgucaccagacgacucgcccga

SEQ ID NO: 2737 - RNA, 51 nt, Artificial Sequence
  Description of Artificial Sequence: Synthetic oligonucleotide
gggaggacgaugcgguccugucgucuguucuuucccagacgacucgcccga

SEQ ID NO: 2738 - RNA, 51 nt, Artificial Sequence
  Description of Artificial Sequence: Synthetic oligonucleotide
gggaggacgaugcggugacucgucugccgacuccccagacgacucgcccga

SEQ ID NO: 2739 - RNA, 52 nt, Artificial Sequence
  Description of Artificial Sequence: Synthetic oligonucleotide
gggaggacgaugcgguuccugucgucuguucguccccagacgacucgcccga

SEQ ID NO: 2740 - RNA, 51 nt, Artificial Sequence
  Description of Artificial Sequence: Synthetic oligonucleotide
gggaggacgaugcgguucuggcuugucguuguccccagacgacucgcccga

SEQ ID NO: 2741 - RNA, 51 nt, Artificial Sequence
  Description of Artificial Sequence: Synthetic oligonucleotide
gggaggacgaugcggucugggacuuuccuccgccccagacgacucgcccga

SEQ ID NO: 2742 - RNA, 51 nt, Artificial Sequence
  Description of Artificial Sequence: Synthetic oligonucleotide
gggaggacgaugcggcccuaucgucuguucguccccagacgacucgcccga

SEQ ID NO: 2743 - RNA, 50 nt, Artificial Sequence
  Description of Artificial Sequence: Synthetic oligonucleotide
gggaggacgaugcggcccugucgucuguuguccccagacgacucgcccga

SEQ ID NO: 2744 - RNA, 51 nt, Artificial Sequence
  Description of Artificial Sequence: Synthetic oligonucleotide
gggaggacgaugcggcccuguugucuguucguccccagacgacucgcccga

SEQ ID NO: 2745 - RNA, 50 nt, Artificial Sequence
  Description of Artificial Sequence: Synthetic oligonucleotide
gggaggacgaugcggcgagccucuguuucuuccccagacgacucgcccga

SEQ ID NO: 2746 - RNA, 51 nt, Artificial Sequence
  Description of Artificial Sequence: Synthetic oligonucleotide
gggaggacgaugcggcgaucuccgucugcacuccccagacgacucgcccga

SEQ ID NO: 2747 - RNA, 51 nt, Artificial Sequence
  Description of Artificial Sequence: Synthetic oligonucleotide
gggaggacgaugcgggccuucgucugucuccuccccagacgacucgcccga

SEQ ID NO: 2748 - RNA, 51 nt, Artificial Sequence
  Description of Artificial Sequence: Synthetic oligonucleotide
gggaggacgaugcgggcguuuccucugcucguccccagacgacucgcccga

SEQ ID NO: 2749 - RNA, 51 nt, Artificial Sequence
  Description of Artificial Sequence: Synthetic oligonucleotide
gggaggacgaugcgggcugucucgucugaccuccccagacgacucgcccga

SEQ ID NO: 2750 - RNA, 51 nt, Artificial Sequence
  Description of Artificial Sequence: Synthetic oligonucleotide
gggaggacgaugcggggcuuuucgucugcccuccccagacgacucgcccga

SEQ ID NO: 2751 - RNA, 52 nt, Artificial Sequence
  Description of Artificial Sequence: Synthetic oligonucleotide
gggaggacgaugcggguccuaucgucuguucguccccagacgacucgcccga

SEQ ID NO: 2752 - RNA, 52 nt, Artificial Sequence
  Description of Artificial Sequence: Synthetic oligonucleotide
gggaggacgaugcggguccugucaucuguucguccccagacgacucgcccga

SEQ ID NO: 2753 - RNA, 51 nt, Artificial Sequence
  Description of Artificial Sequence: Synthetic oligonucleotide
gggaggacgaugcggguguuucgucguugcguccccagacgacucgcccga

SEQ ID NO: 2754 - RNA, 51 nt, Artificial Sequence
  Description of Artificial Sequence: Synthetic oligonucleotide
gggaggacgaugcggucauguagucuguucguccccagacgacucgcccga

SEQ ID NO: 2755 - RNA, 51 nt, Artificial Sequence
  Description of Artificial Sequence: Synthetic oligonucleotide
gggaggacgaugcgguccugucgucugcuccuccccagacgacucgcccga

SEQ ID NO: 2756 - RNA, 51 nt, Artificial Sequence
  Description of Artificial Sequence: Synthetic oligonucleotide
gggaggacgaugcggucuugucguccguucguccccagacgacucgcccga

SEQ ID NO: 2757 - RNA, 51 nt, Artificial Sequence
  Description of Artificial Sequence: Synthetic oligonucleotide
gggaggacgaugcggugcggucucugguuccuccccagacgacucgcccga

SEQ ID NO: 2758 - RNA, 48 nt, Artificial Sequence
  Description of Artificial Sequence: Synthetic oligonucleotide
gggaggacgaugcggugucgucuguucguccccagacgacucgcccga

SEQ ID NO: 2759 - RNA, 51 nt, Artificial Sequence
  Description of Artificial Sequence: Synthetic oligonucleotide
gggaggacgaugcgguccugucgucuguuaguacacagacgacucgcccga

SEQ ID NO: 2760 - RNA, 51 nt, Artificial Sequence
  Description of Artificial Sequence: Synthetic oligonucleotide
gggaggacgaugcggucucuggguuuuugcugccccagacgacucgcccga

SEQ ID NO: 2761 - RNA, 51 nt, Artificial Sequence
  Description of Artificial Sequence: Synthetic oligonucleotide
gggaggacgaugcgguuugggguuuuucccguccccagacgacucgcccga

SEQ ID NO: 2762 - RNA, 51 nt, Artificial Sequence
  Description of Artificial Sequence: Synthetic oligonucleotide
gggaggacgaugcgggaucauguuuuccuuucguccagacgacucgcccga

SEQ ID NO: 2763 - RNA, 51 nt, Artificial Sequence
  Description of Artificial Sequence: Synthetic oligonucleotide
gggaggacgaugcggccaguuguucugagccuccccagacgacucgcccga

SEQ ID NO: 2764 - RNA, 51 nt, Artificial Sequence
  Description of Artificial Sequence: Synthetic oligonucleotide
gggaggacgaugcggccaugucgucuguucguccccagacgacucgcccga

SEQ ID NO: 2765 - RNA, 50 nt, Artificial Sequence
  Description of Artificial Sequence: Synthetic oligonucleotide
gggaggacgaugcggcccugucgucugucguccccagacgacucgcccga

SEQ ID NO: 2766 - RNA, 51 nt, Artificial Sequence
  Description of Artificial Sequence: Synthetic oligonucleotide
gggaggacgaugcggcgacuuccgucugcgcuccccagacgacucgcccga

SEQ ID NO: 2767 - RNA, 51 nt, Artificial Sequence
  Description of Artificial Sequence: Synthetic oligonucleotide
gggaggacgaugcggcuugucuucugguucguccccagacgacucgcccga

SEQ ID NO: 2768 - RNA, 51 nt, Artificial Sequence
  Description of Artificial Sequence: Synthetic oligonucleotide
gggaggacgaugcgggccuucgucugcuuacuccccagacgacucgcccga

SEQ ID NO: 2769 - RNA, 51 nt, Artificial Sequence
  Description of Artificial Sequence: Synthetic oligonucleotide
gggaggacgaugcgguccuagcuugucguuguccccagacgacucgcccga

SEQ ID NO: 2770 - RNA, 51 nt, Artificial Sequence
  Description of Artificial Sequence: Synthetic oligonucleotide
gggaggacgaugcgguccugguuugucguuguccccagacgacucgcccga

SEQ ID NO: 2771 - RNA, 52 nt, Artificial Sequence
  Description of Artificial Sequence: Synthetic oligonucleotide
gggaggacgaugcgguccugucgucuuguucguccccagacgacucgcccga

SEQ ID NO: 2772 - RNA, 51 nt, Artificial Sequence
  Description of Artificial Sequence: Synthetic oligonucleotide
gggaggacgaugcgguccugucguucguucguccccagacgacucgcccga

SEQ ID NO: 2773 - RNA, 51 nt, Artificial Sequence
  Description of Artificial Sequence: Synthetic oligonucleotide
gggaggacgaugcggucuugccgucuguucguccccagacgacucgcccga

SEQ ID NO: 2774 - RNA, 51 nt, Artificial Sequence
  Description of Artificial Sequence: Synthetic oligonucleotide
gggaggacgaugcggucuugucgucuguucgcccccagacgacucgcccga

SEQ ID NO: 2775 - RNA, 51 nt, Artificial Sequence
  Description of Artificial Sequence: Synthetic oligonucleotide
gggaggacgaugcggugccuucgucugcuccuccccagacgacucgcccga

SEQ ID NO: 2776 - RNA, 51 nt, Artificial Sequence
  Description of Artificial Sequence: Synthetic oligonucleotide
gggaggacgaugcggguccuuucgucugugcuccccagacgacucgcccga

SEQ ID NO: 2777 - RNA, 51 nt, Artificial Sequence
  Description of Artificial Sequence: Synthetic oligonucleotide
gggaggacgaugcgguucgggguuuucccgugccccagacgacucgcccga

SEQ ID NO: 2778 - RNA, 52 nt, Artificial Sequence
  Description of Artificial Sequence: Synthetic oligonucleotide
gggaggacgaugcgguuugggguuuuccccgugccccagacgacucgcccga

SEQ ID NO: 2779 - RNA, 51 nt, Artificial Sequence
  Description of Artificial Sequence: Synthetic oligonucleotide
gggaggacgaugcggcccuggcuugucguuguccccagacgacucgcccga

SEQ ID NO: 2780 - RNA, 51 nt, Artificial Sequence
  Description of Artificial Sequence: Synthetic oligonucleotide
gggaggacgaugcggccgucucgucuguagcuccccagacgacucgcccga

SEQ ID NO: 2781 - RNA, 50 nt, Artificial Sequence
  Description of Artificial Sequence: Synthetic oligonucleotide
gggaggacgaugcggccugaucgucugugcuccccagacgacucgcccga

SEQ ID NO: 2782 - RNA, 51 nt, Artificial Sequence
  Description of Artificial Sequence: Synthetic oligonucleotide
gggaggacgaugcggccugucguuuguuuccgccccagacgacucgcccga

SEQ ID NO: 2783 - RNA, 51 nt, Artificial Sequence
  Description of Artificial Sequence: Synthetic oligonucleotide
gggaggacgaugcggcgacuuccgucugucucccccagacgacucgcccga

SEQ ID NO: 2784 - RNA, 51 nt, Artificial Sequence
  Description of Artificial Sequence: Synthetic oligonucleotide
gggaggacgaugcggcgauccucgucuguuguccccagacgacucgcccga

SEQ ID NO: 2785 - RNA, 51 nt, Artificial Sequence
  Description of Artificial Sequence: Synthetic oligonucleotide
gggaggacgaugcggcuugucgucuugcucguccccagacgacucgcccga

SEQ ID NO: 2786 - RNA, 51 nt, Artificial Sequence
  Description of Artificial Sequence: Synthetic oligonucleotide
gggaggacgaugcgggcaucucgucuguaccuccccagacgacucgcccga

SEQ ID NO: 2787 - RNA, 51 nt, Artificial Sequence
  Description of Artificial Sequence: Synthetic oligonucleotide
gggaggacgaugcgggccucuugucuguugcuccccagacgacucgcccga

SEQ ID NO: 2788 - RNA, 51 nt, Artificial Sequence
  Description of Artificial Sequence: Synthetic oligonucleotide
gggaggacgaugcgggccugucguguuuucguccccagacgacucgcccga

SEQ ID NO: 2789 - RNA, 51 nt, Artificial Sequence
  Description of Artificial Sequence: Synthetic oligonucleotide
gggaggacgaugcgggccuuucgucucuacguccccagacgacucgcccga

SEQ ID NO: 2790 - RNA, 51 nt, Artificial Sequence
  Description of Artificial Sequence: Synthetic oligonucleotide
gggaggacgaugcgggccuuucguuugcucuuccccagacgacucgcccga

SEQ ID NO: 2791 - RNA, 51 nt, Artificial Sequence
  Description of Artificial Sequence: Synthetic oligonucleotide
gggaggacgaugcgggcguuuccucugcccuuccccagacgacucgcccga

SEQ ID NO: 2792 - RNA, 52 nt, Artificial Sequence
  Description of Artificial Sequence: Synthetic oligonucleotide
gggaggacgaugcggguccugucgucuguucguccacagacgacucgcccga

SEQ ID NO: 2793 - RNA, 52 nt, Artificial Sequence
  Description of Artificial Sequence: Synthetic oligonucleotide
gggaggacgaugcggguucugucgucuguucguccccagacgacucgcccga

SEQ ID NO: 2794 - RNA, 51 nt, Artificial Sequence
  Description of Artificial Sequence: Synthetic oligonucleotide
gggaggacgaugcgguacuguagucuguucguccccagacgacucgcccga

SEQ ID NO: 2795 - RNA, 51 nt, Artificial Sequence
  Description of Artificial Sequence: Synthetic oligonucleotide
gggaggacgaugcgguacugucgucuguucgucaccagacgacucgcccga

SEQ ID NO: 2796 - RNA, 51 nt, Artificial Sequence
  Description of Artificial Sequence: Synthetic oligonucleotide
gggaggacgaugcgguacugucgucuguucguccacagacgacucgcccga

SEQ ID NO: 2797 - RNA, 51 nt, Artificial Sequence
  Description of Artificial Sequence: Synthetic oligonucleotide
gggaggacgaugcggucuugucgucuauucguccccagacgacucgcccga

SEQ ID NO: 2798 - RNA, 51 nt, Artificial Sequence
  Description of Artificial Sequence: Synthetic oligonucleotide
gggaggacgaugcggucuugucgucuguucauccccagacgacucgcccga

SEQ ID NO: 2799 - RNA, 51 nt, Artificial Sequence
  Description of Artificial Sequence: Synthetic oligonucleotide
gggaggacgaugcggucuugucgucuguuccuccccagacgacucgcccga

SEQ ID NO: 2800 - RNA, 52 nt, Artificial Sequence
  Description of Artificial Sequence: Synthetic oligonucleotide
gggaggacgaugcgguuuugggguuuucccgugccccagacgacucgcccga

SEQ ID NO: 2801 - RNA, 51 nt, Artificial Sequence
  Description of Artificial Sequence: Synthetic oligonucleotide
gggaggacgaugcggcccuguagucuguucguccccagacgacucgcccga

SEQ ID NO: 2802 - RNA, 51 nt, Artificial Sequence
  Description of Artificial Sequence: Synthetic oligonucleotide
gggaggacgaugcggcccugucgucuguuaguccccagacgacucgcccga

SEQ ID NO: 2803 - RNA, 51 nt, Artificial Sequence
  Description of Artificial Sequence: Synthetic oligonucleotide
gggaggacgaugcggcccugucgucuguucguacccagacgacucgcccga

SEQ ID NO: 2804 - RNA, 51 nt, Artificial Sequence
  Description of Artificial Sequence: Synthetic oligonucleotide
gggaggacgaugcggcccugucgucuguucguccucagacgacucgcccga

SEQ ID NO: 2805 - RNA, 50 nt, Artificial Sequence
  Description of Artificial Sequence: Synthetic oligonucleotide
gggaggacgaugcggcccugucgucuguucuccccagacgacucgcccga

SEQ ID NO: 2806 - RNA, 51 nt, Artificial Sequence
  Description of Artificial Sequence: Synthetic oligonucleotide
gggaggacgaugcggcgacucuucugcuccugccccagacgacucgcccga

SEQ ID NO: 2807 - RNA, 51 nt, Artificial Sequence
  Description of Artificial Sequence: Synthetic oligonucleotide
gggaggacgaugcggcgucuccucugguucguccccagacgacucgcccga

SEQ ID NO: 2808 - RNA, 51 nt, Artificial Sequence
  Description of Artificial Sequence: Synthetic oligonucleotide
gggaggacgaugcggcgucuucgucugugggccgccagacgacucgcccga

SEQ ID NO: 2809 - RNA, 51 nt, Artificial Sequence
  Description of Artificial Sequence: Synthetic oligonucleotide
gggaggacgaugcggcguuucguucugaccguccccagacgacucgcccga

SEQ ID NO: 2810 - RNA, 51 nt, Artificial Sequence
  Description of Artificial Sequence: Synthetic oligonucleotide
gggaggacgaugcgggcauucgaucugccacuccccagacgacucgcccga

SEQ ID NO: 2811 - RNA, 51 nt, Artificial Sequence
  Description of Artificial Sequence: Synthetic oligonucleotide
gggaggacgaugcgggcccuucguucugaccuccccagacgacucgcccga

SEQ ID NO: 2812 - RNA, 51 nt, Artificial Sequence
  Description of Artificial Sequence: Synthetic oligonucleotide
gggaggacgaugcgggccuacucgucugaccuccccagacgacucgcccga

SEQ ID NO: 2813 - RNA, 51 nt, Artificial Sequence
  Description of Artificial Sequence: Synthetic oligonucleotide
gggaggacgaugcgggcuuuucgucugcgccuccccagacgacucgcccga

SEQ ID NO: 2814 - RNA, 51 nt, Artificial Sequence
  Description of Artificial Sequence: Synthetic oligonucleotide
gggaggacgaugcgguacugucguauguucguccccagacgacucgcccga

SEQ ID NO: 2815 - RNA, 51 nt, Artificial Sequence
  Description of Artificial Sequence: Synthetic oligonucleotide
gggaggacgaugcgguccugacgucuguucguccacagacgacucgcccga

SEQ ID NO: 2816 - RNA, 51 nt, Artificial Sequence
  Description of Artificial Sequence: Synthetic oligonucleotide
gggaggacgaugcgguccuggcuugucguuauccccagacgacucgcccga

SEQ ID NO: 2817 - RNA, 50 nt, Artificial Sequence
  Description of Artificial Sequence: Synthetic oligonucleotide
gggaggacgaugcgguccuggcuugucuuguccccagacgacucgcccga

SEQ ID NO: 2818 - RNA, 51 nt, Artificial Sequence
  Description of Artificial Sequence: Synthetic oligonucleotide
gggaggacgaugcgguccugucgucuguucgcucccagacgacucgcccga

SEQ ID NO: 2819 - RNA, 51 nt, Artificial Sequence
  Description of Artificial Sequence: Synthetic oligonucleotide
gggaggacgaugcgguccugucgucuguucgucggcagacgacucgcccga

SEQ ID NO: 2820 - RNA, 51 nt, Artificial Sequence
  Description of Artificial Sequence: Synthetic oligonucleotide
gggaggacgaugcgguccugucgucuguucguuaccagacgacucgcccga

SEQ ID NO: 2821 - RNA, 51 nt, Artificial Sequence
  Description of Artificial Sequence: Synthetic oligonucleotide
gggaggacgaugcggucggucgucuacuucguccccagacgacucgcccga

SEQ ID NO: 2822 - RNA, 51 nt, Artificial Sequence
  Description of Artificial Sequence: Synthetic oligonucleotide
gggaggacgaugcggucucugguguuucgggccgccagacgacucgcccga

SEQ ID NO: 2823 - RNA, 51 nt, Artificial Sequence
  Description of Artificial Sequence: Synthetic oligonucleotide
gggaggacgaugcggucuugucgucuguccguccccagacgacucgcccga

SEQ ID NO: 2824 - RNA, 50 nt, Artificial Sequence
  Description of Artificial Sequence: Synthetic oligonucleotide
gggaggacgaugcggucuugucgucuguuguccccagacgacucgcccga

SEQ ID NO: 2825 - RNA, 51 nt, Artificial Sequence
  Description of Artificial Sequence: Synthetic oligonucleotide
gggaggacgaugcggugaaucguucugcgccuccccagacgacucgcccga

SEQ ID NO: 2826 - RNA, 51 nt, Artificial Sequence
  Description of Artificial Sequence: Synthetic oligonucleotide
gggaggacgaugcggacggcucgucuguugcuccccagacgacucgcccga

SEQ ID NO: 2827 - RNA, 51 nt, Artificial Sequence
  Description of Artificial Sequence: Synthetic oligonucleotide
gggaggacgaugcggcagucguucugucuccuccccagacgacucgcccga

SEQ ID NO: 2828 - RNA, 51 nt, Artificial Sequence
  Description of Artificial Sequence: Synthetic oligonucleotide
gggaggacgaugcggcccugucguuuguucguccccagacgacucgcccga

SEQ ID NO: 2829 - RNA, 51 nt, Artificial Sequence
  Description of Artificial Sequence: Synthetic oligonucleotide
gggaggacgaugcggccgugucgucuguacugccccagacgacucgcccga

SEQ ID NO: 2830 - RNA, 51 nt, Artificial Sequence
  Description of Artificial Sequence: Synthetic oligonucleotide
gggaggacgaugcggcgacucgaucuguaacuccccagacgacucgcccga

SEQ ID NO: 2831 - RNA, 50 nt, Artificial Sequence
  Description of Artificial Sequence: Synthetic oligonucleotide
gggaggacgaugcggcuugucgucuguucguccccagacgacucgcccga

SEQ ID NO: 2832 - RNA, 51 nt, Artificial Sequence
  Description of Artificial Sequence: Synthetic oligonucleotide
gggaggacgaugcgggccucucgucuguucguccccagacgacucgcccga

SEQ ID NO: 2833 - RNA, 51 nt, Artificial Sequence
  Description of Artificial Sequence: Synthetic oligonucleotide
gggaggacgaugcgggccuucguuuguacccuccccagacgacucgcccga

SEQ ID NO: 2834 - RNA, 51 nt, Artificial Sequence
  Description of Artificial Sequence: Synthetic oligonucleotide
gggaggacgaugcgggcgauuccucugcaccuccccagacgacucgcccga

SEQ ID NO: 2835 - RNA, 52 nt, Artificial Sequence
  Description of Artificial Sequence: Synthetic oligonucleotide
gggaggacgaugcggguccugucgucugaucguccccagacgacucgcccga

SEQ ID NO: 2836 - RNA, 51 nt, Artificial Sequence
  Description of Artificial Sequence: Synthetic oligonucleotide
gggaggacgaugcggguuugucgucuguucguccccagacgacucgcccga

SEQ ID NO: 2837 - RNA, 51 nt, Artificial Sequence
  Description of Artificial Sequence: Synthetic oligonucleotide
gggaggacgaugcggucaugucguauguucguccccagacgacucgcccga

SEQ ID NO: 2838 - RNA, 51 nt, Artificial Sequence
  Description of Artificial Sequence: Synthetic oligonucleotide
gggaggacgaugcggucaugucgucuguucguacacagacgacucgcccga

SEQ ID NO: 2839 - RNA, 50 nt, Artificial Sequence
  Description of Artificial Sequence: Synthetic oligonucleotide
gggaggacgaugcgguccugucgucuguccuccccagacgacucgcccga

SEQ ID NO: 2840 - RNA, 51 nt, Artificial Sequence
  Description of Artificial Sequence: Synthetic oligonucleotide
gggaggacgaugcgguccugucgucuguucguucacagacgacucgcccga

SEQ ID NO: 2841 - RNA, 49 nt, Artificial Sequence
  Description of Artificial Sequence: Synthetic oligonucleotide
gggaggacgaugcgguccugucgucuguucucccagacgacucgcccga

SEQ ID NO: 2842 - RNA, 51 nt, Artificial Sequence
  Description of Artificial Sequence: Synthetic oligonucleotide
gggaggacgaugcgguccugucguuuguuuguccccagacgacucgcccga

SEQ ID NO: 2843 - RNA, 51 nt, Artificial Sequence
  Description of Artificial Sequence: Synthetic oligonucleotide
gggaggacgaugcggucgguucugguuucugccgccagacgacucgcccga

SEQ ID NO: 2844 - RNA, 51 nt, Artificial Sequence
  Description of Artificial Sequence: Synthetic oligonucleotide
gggaggacgaugcggucuugucgucuguucguacccagacgacucgcccga

SEQ ID NO: 2845 - RNA, 51 nt, Artificial Sequence
  Description of Artificial Sequence: Synthetic oligonucleotide
gggaggacgaugcggucuuguugucuguucguccccagacgacucgcccga

SEQ ID NO: 2846 - RNA, 51 nt, Artificial Sequence
  Description of Artificial Sequence: Synthetic oligonucleotide
gggaggacgaugcgguggucgucugauuucguccccagacgacucgcccga

SEQ ID NO: 2847 - RNA, 51 nt, Artificial Sequence
  Description of Artificial Sequence: Synthetic oligonucleotide
gggaggacgaugcgguuuggggauuucccgugccccagacgacucgcccga

SEQ ID NO: 2848 - RNA, 51 nt, Artificial Sequence
  Description of Artificial Sequence: Synthetic oligonucleotide
gggaggacgaugcgguuugggguuuucccgugucccagacgacucgcccga

SEQ ID NO: 2849 - RNA, 51 nt, Artificial Sequence
  Description of Artificial Sequence: Synthetic oligonucleotide
gggaggacgaugcgguuugggguuaucccgugccccagacgacucgcccga

SEQ ID NO: 2850 - RNA, 51 nt, Artificial Sequence
  Description of Artificial Sequence: Synthetic oligonucleotide
gggaggacgaugcgguuugggguuuucccgugccucagacgacucgcccga

SEQ ID NO: 2851 - RNA, 51 nt, Artificial Sequence
  Description of Artificial Sequence: Synthetic oligonucleotide
gggaggacgaugcgguuugggguuuucccguaccccagacgacucgcccga

SEQ ID NO: 2852 - RNA, 51 nt, Artificial Sequence
  Description of Artificial Sequence: Synthetic oligonucleotide
gggaggacgaugcggacguucucgucuguggccgccagacgacucgcccga

SEQ ID NO: 2853 - RNA, 51 nt, Artificial Sequence
  Description of Artificial Sequence: Synthetic oligonucleotide
gggaggacgaugcggcccagucgucuguucguccccagacgacucgcccga

SEQ ID NO: 2854 - RNA, 51 nt, Artificial Sequence
  Description of Artificial Sequence: Synthetic oligonucleotide
gggaggacgaugcggcccugucgucuguucguccacagacgacucgcccga

SEQ ID NO: 2855 - RNA, 51 nt, Artificial Sequence
  Description of Artificial Sequence: Synthetic oligonucleotide
gggaggacgaugcggccgaguuguuugcgccuccccagacgacucgcccga

SEQ ID NO: 2856 - RNA, 51 nt, Artificial Sequence
  Description of Artificial Sequence: Synthetic oligonucleotide
gggaggacgaugcggcguugucggucugugcuccccagacgacucgcccga

SEQ ID NO: 2857 - RNA, 51 nt, Artificial Sequence
  Description of Artificial Sequence: Synthetic oligonucleotide
gggaggacgaugcgggccucgucugaacuccuccccagacgacucgcccga

SEQ ID NO: 2858 - RNA, 51 nt, Artificial Sequence
  Description of Artificial Sequence: Synthetic oligonucleotide
gggaggacgaugcgggcgucuccucuguucguccccagacgacucgcccga

SEQ ID NO: 2859 - RNA, 51 nt, Artificial Sequence
  Description of Artificial Sequence: Synthetic oligonucleotide
gggaggacgaugcgggcuacucguucugcccuccccagacgacucgcccga

SEQ ID NO: 2860 - RNA, 51 nt, Artificial Sequence
  Description of Artificial Sequence: Synthetic oligonucleotide
gggaggacgaugcgggcucguucgucuuucguccccagacgacucgcccga

SEQ ID NO: 2861 - RNA, 51 nt, Artificial Sequence
  Description of Artificial Sequence: Synthetic oligonucleotide
gggaggacgaugcgggcuuuucguuuguucguccccagacgacucgcccga

SEQ ID NO: 2862 - RNA, 52 nt, Artificial Sequence
  Description of Artificial Sequence: Synthetic oligonucleotide
gggaggacgaugcggguccugucgucuguuaguccccagacgacucgcccga

SEQ ID NO: 2863 - RNA, 51 nt, Artificial Sequence
  Description of Artificial Sequence: Synthetic oligonucleotide
gggaggacgaugcggguguucgucuguuucguccccagacgacucgcccga

SEQ ID NO: 2864 - RNA, 52 nt, Artificial Sequence
  Description of Artificial Sequence: Synthetic oligonucleotide
gggaggacgaugcggguucgucguuuguuucguccccagacgacucgcccga

SEQ ID NO: 2865 - RNA, 51 nt, Artificial Sequence
  Description of Artificial Sequence: Synthetic oligonucleotide
gggaggacgaugcgguccugacuugucguuguccccagacgacucgcccga

SEQ ID NO: 2866 - RNA, 51 nt, Artificial Sequence
  Description of Artificial Sequence: Synthetic oligonucleotide
gggaggacgaugcgguccugccgucuguucguucccagacgacucgcccga

SEQ ID NO: 2867 - RNA, 51 nt, Artificial Sequence
  Description of Artificial Sequence: Synthetic oligonucleotide
gggaggacgaugcgguccugucgucugcuuguccccagacgacucgcccga

SEQ ID NO: 2868 - RNA, 51 nt, Artificial Sequence
  Description of Artificial Sequence: Synthetic oligonucleotide
gggaggacgaugcgguccugucgucuguccuuccccagacgacucgcccga

SEQ ID NO: 2869 - RNA, 50 nt, Artificial Sequence
  Description of Artificial Sequence: Synthetic oligonucleotide
gggaggacgaugcggucuugucgucuguucuccccagacgacucgcccga

SEQ ID NO: 2870 - RNA, 51 nt, Artificial Sequence
  Description of Artificial Sequence: Synthetic oligonucleotide
gggaggacgaugcggugacucgucugucucguccccagacgacucgcccga

SEQ ID NO: 2871 - RNA, 51 nt, Artificial Sequence
  Description of Artificial Sequence: Synthetic oligonucleotide
gggaggacgaugcgguuugggguuuucccguuccccagacgacucgcccga

SEQ ID NO: 2872 - RNA, 50 nt, Artificial Sequence
  Description of Artificial Sequence: Synthetic oligonucleotide
gggaggacgaugcgguuugggguuuucccguccccagacgacucgcccga

SEQ ID NO: 2873 - RNA, 51 nt, Artificial Sequence
  Description of Artificial Sequence: Synthetic oligonucleotide
gggaggacgaugcgguuugggguuuuccugugccccagacgacucgcccga

SEQ ID NO: 2874 - RNA, 52 nt, Artificial Sequence
  Description of Artificial Sequence: Synthetic oligonucleotide
gggaggacgaugcgguuuggggcuuuucccgugccccagacgacucgcccga

SEQ ID NO: 2875 - RNA, 51 nt, Artificial Sequence
  Description of Artificial Sequence: Synthetic oligonucleotide
gggaggacgaugcggaccugucgucuguucguccacagacgacucgcccga

SEQ ID NO: 2876 - RNA, 51 nt, Artificial Sequence
  Description of Artificial Sequence: Synthetic oligonucleotide
gggaggacgaugcggcccuguccucuguucguccccagacgacucgcccga

SEQ ID NO: 2877 - RNA, 51 nt, Artificial Sequence
  Description of Artificial Sequence: Synthetic oligonucleotide
gggaggacgaugcggcccugucgucuauucguccccagacgacucgcccga

SEQ ID NO: 2878 - RNA, 48 nt, Artificial Sequence
  Description of Artificial Sequence: Synthetic oligonucleotide
gggaggacgaugcggcccugucgucuguuccccagacgacucgcccga

SEQ ID NO: 2879 - RNA, 51 nt, Artificial Sequence
  Description of Artificial Sequence: Synthetic oligonucleotide
gggaggacgaugcggccgauucguuugccacuccccagacgacucgcccga

SEQ ID NO: 2880 - RNA, 51 nt, Artificial Sequence
  Description of Artificial Sequence: Synthetic oligonucleotide
gggaggacgaugcggccugaucgucugcagcuccccagacgacucgcccga

SEQ ID NO: 2881 - RNA, 52 nt, Artificial Sequence
  Description of Artificial Sequence: Synthetic oligonucleotide
gggaggacgaugcggccugucgucuuuuuucguccccagacgacucgcccga

SEQ ID NO: 2882 - RNA, 51 nt, Artificial Sequence
  Description of Artificial Sequence: Synthetic oligonucleotide
gggaggacgaugcggcgacucucugauguccaccccagacgacucgcccga

SEQ ID NO: 2883 - RNA, 51 nt, Artificial Sequence
  Description of Artificial Sequence: Synthetic oligonucleotide
gggaggacgaugcggcgcuuccucugguucguccccagacgacucgcccga

SEQ ID NO: 2884 - RNA, 51 nt, Artificial Sequence
  Description of Artificial Sequence: Synthetic oligonucleotide
gggaggacgaugcggcgcuuucguucugcgcuccccagacgacucgcccga

SEQ ID NO: 2885 - RNA, 51 nt, Artificial Sequence
  Description of Artificial Sequence: Synthetic oligonucleotide
gggaggacgaugcggcgcuuuucgucugcucuccccagacgacucgcccga

SEQ ID NO: 2886 - RNA, 51 nt, Artificial Sequence
  Description of Artificial Sequence: Synthetic oligonucleotide
gggaggacgaugcggcguaucucgucugcucuccccagacgacucgcccga

SEQ ID NO: 2887 - RNA, 51 nt, Artificial Sequence
  Description of Artificial Sequence: Synthetic oligonucleotide
gggaggacgaugcgggcaugcucgucucacguccccagacgacucgcccga

SEQ ID NO: 2888 - RNA, 51 nt, Artificial Sequence
  Description of Artificial Sequence: Synthetic oligonucleotide
gggaggacgaugcgggccacucgucuaaaccuccccagacgacucgcccga

SEQ ID NO: 2889 - RNA, 51 nt, Artificial Sequence
  Description of Artificial Sequence: Synthetic oligonucleotide
gggaggacgaugcgggcccuucguuugacacuccccagacgacucgcccga

SEQ ID NO: 2890 - RNA, 52 nt, Artificial Sequence
  Description of Artificial Sequence: Synthetic oligonucleotide
gggaggacgaugcgggcguuuccucugguucguccccagacgacucgcccga

SEQ ID NO: 2891 - RNA, 51 nt, Artificial Sequence
  Description of Artificial Sequence: Synthetic oligonucleotide
gggaggacgaugcgggcguuuccucuguccguccccagacgacucgcccga

SEQ ID NO: 2892 - RNA, 52 nt, Artificial Sequence
  Description of Artificial Sequence: Synthetic oligonucleotide
gggaggacgaugcggguccucucgucuguucguccccagacgacucgcccga

SEQ ID NO: 2893 - RNA, 52 nt, Artificial Sequence
  Description of Artificial Sequence: Synthetic oligonucleotide
gggaggacgaugcggguccuuucgucuguucguccccagacgacucgcccga

SEQ ID NO: 2894 - RNA, 51 nt, Artificial Sequence
  Description of Artificial Sequence: Synthetic oligonucleotide
gggaggacgaugcgggucuucgucuguugccuccccagacgacucgcccga

SEQ ID NO: 2895 - RNA, 51 nt, Artificial Sequence
  Description of Artificial Sequence: Synthetic oligonucleotide
gggaggacgaugcggguucauuuuugccgcguggccagacgacucgcccga

SEQ ID NO: 2896 - RNA, 51 nt, Artificial Sequence
  Description of Artificial Sequence: Synthetic oligonucleotide
gggaggacgaugcggguucgucgucuuaucguccccagacgacucgcccga

SEQ ID NO: 2897 - RNA, 51 nt, Artificial Sequence
  Description of Artificial Sequence: Synthetic oligonucleotide
gggaggacgaugcgguaaugucgucuguucguccccagacgacucgcccga

SEQ ID NO: 2898 - RNA, 51 nt, Artificial Sequence
  Description of Artificial Sequence: Synthetic oligonucleotide
gggaggacgaugcgguacugucgucuguuaguccccagacgacucgcccga

SEQ ID NO: 2899 - RNA, 51 nt, Artificial Sequence
  Description of Artificial Sequence: Synthetic oligonucleotide
gggaggacgaugcggucaugucgucuguuaguacccagacgacucgcccga

SEQ ID NO: 2900 - RNA, 51 nt, Artificial Sequence
  Description of Artificial Sequence: Synthetic oligonucleotide
gggaggacgaugcgguccugacgucuguucguacccagacgacucgcccga

SEQ ID NO: 2901 - RNA, 51 nt, Artificial Sequence
  Description of Artificial Sequence: Synthetic oligonucleotide
gggaggacgaugcgguccuguagucuguuagucaccagacgacucgcccga

SEQ ID NO: 2902 - RNA, 51 nt, Artificial Sequence
  Description of Artificial Sequence: Synthetic oligonucleotide
gggaggacgaugcgguccuguagucuguucguacacagacgacucgcccga

SEQ ID NO: 2903 - RNA, 51 nt, Artificial Sequence
  Description of Artificial Sequence: Synthetic oligonucleotide
gggaggacgaugcgguccugucgccuguucgcccccagacgacucgcccga

SEQ ID NO: 2904 - RNA, 51 nt, Artificial Sequence
  Description of Artificial Sequence: Synthetic oligonucleotide
gggaggacgaugcgguccugucguccguucgcccccagacgacucgcccga

SEQ ID NO: 2905 - RNA, 49 nt, Artificial Sequence
  Description of Artificial Sequence: Synthetic oligonucleotide
gggaggacgaugcgguccugucgucgucguccccagacgacucgcccga

SEQ ID NO: 2906 - RNA, 51 nt, Artificial Sequence
  Description of Artificial Sequence: Synthetic oligonucleotide
gggaggacgaugcgguccugucgucugaucguacccagacgacucgcccga

SEQ ID NO: 2907 - RNA, 51 nt, Artificial Sequence
  Description of Artificial Sequence: Synthetic oligonucleotide
gggaggacgaugcgguccugucgucugcccguccccagacgacucgcccga

SEQ ID NO: 2908 - RNA, 48 nt, Artificial Sequence
  Description of Artificial Sequence: Synthetic oligonucleotide
gggaggacgaugcgguccugucgucugguccccagacgacucgcccga

SEQ ID NO: 2909 - RNA, 51 nt, Artificial Sequence
  Description of Artificial Sequence: Synthetic oligonucleotide
gggaggacgaugcgguccugucgucuguuccuucccagacgacucgcccga

SEQ ID NO: 2910 - RNA, 48 nt, Artificial Sequence
  Description of Artificial Sequence: Synthetic oligonucleotide
gggaggacgaugcgguccugucgucuguucgucagacgacucgcccga

SEQ ID NO: 2911 - RNA, 51 nt, Artificial Sequence
  Description of Artificial Sequence: Synthetic oligonucleotide
gggaggacgaugcgguccuugcuugucguuguccccagacgacucgcccga

SEQ ID NO: 2912 - RNA, 51 nt, Artificial Sequence
  Description of Artificial Sequence: Synthetic oligonucleotide
gggaggacgaugcggucuugucgccuguucguccccagacgacucgcccga

SEQ ID NO: 2913 - RNA, 51 nt, Artificial Sequence
  Description of Artificial Sequence: Synthetic oligonucleotide
gggaggacgaugcggugagcgucugcuuucguccccagacgacucgcccga

SEQ ID NO: 2914 - RNA, 51 nt, Artificial Sequence
  Description of Artificial Sequence: Synthetic oligonucleotide
gggaggacgaugcggugauguucgucugccguccccagacgacucgcccga

SEQ ID NO: 2915 - RNA, 51 nt, Artificial Sequence
  Description of Artificial Sequence: Synthetic oligonucleotide
gggaggacgaugcgguccugucgucuuuucguucccagacgacucgcccga

SEQ ID NO: 2916 - RNA, 51 nt, Artificial Sequence
  Description of Artificial Sequence: Synthetic oligonucleotide
gggaggacgaugcgguuugggguuuuccccugccccagacgacucgcccga

SEQ ID NO: 2917 - RNA, 51 nt, Artificial Sequence
  Description of Artificial Sequence: Synthetic oligonucleotide
gggaggacgaugcggagccuuucgucugcacuccccagacgacucgcccga

SEQ ID NO: 2918 - RNA, 51 nt, Artificial Sequence
  Description of Artificial Sequence: Synthetic oligonucleotide
gggaggacgaugcggccauucgucugauaccuccccagacgacucgcccga

SEQ ID NO: 2919 - RNA, 51 nt, Artificial Sequence
  Description of Artificial Sequence: Synthetic oligonucleotide
gggaggacgaugcggcccgucgucuuuugccuccccagacgacucgcccga

SEQ ID NO: 2920 - RNA, 51 nt, Artificial Sequence
  Description of Artificial Sequence: Synthetic oligonucleotide
gggaggacgaugcggcccugucgucucuucguccccagacgacucgcccga

SEQ ID NO: 2921 - RNA, 51 nt, Artificial Sequence
  Description of Artificial Sequence: Synthetic oligonucleotide
gggaggacgaugcggccugucgucuuacacguccccagacgacucgcccga

SEQ ID NO: 2922 - RNA, 51 nt, Artificial Sequence
  Description of Artificial Sequence: Synthetic oligonucleotide
gggaggacgaugcggcgacgucugaauuaccuccccagacgacucgcccga

SEQ ID NO: 2923 - RNA, 51 nt, Artificial Sequence
  Description of Artificial Sequence: Synthetic oligonucleotide
gggaggacgaugcggcgacuccucuguauccuccgcagacgacucgcccga

SEQ ID NO: 2924 - RNA, 51 nt, Artificial Sequence
  Description of Artificial Sequence: Synthetic oligonucleotide
gggaggacgaugcggcgagccucugaaucucuccccagacgacucgcccga

SEQ ID NO: 2925 - RNA, 51 nt, Artificial Sequence
  Description of Artificial Sequence: Synthetic oligonucleotide
gggaggacgaugcggcguaguccucugaaccuccccagacgacucgcccga

SEQ ID NO: 2926 - RNA, 51 nt, Artificial Sequence
  Description of Artificial Sequence: Synthetic oligonucleotide
gggaggacgaugcggcuagucguuugccuccuccccagacgacucgcccga

SEQ ID NO: 2927 - RNA, 51 nt, Artificial Sequence
  Description of Artificial Sequence: Synthetic oligonucleotide
gggaggacgaugcggcuuugucgucuguucguccccagacgacucgcccga

SEQ ID NO: 2928 - RNA, 51 nt, Artificial Sequence
  Description of Artificial Sequence: Synthetic oligonucleotide
gggaggacgaugcgggagucucgucugucccuccccagacgacucgcccga

SEQ ID NO: 2929 - RNA, 51 nt, Artificial Sequence
  Description of Artificial Sequence: Synthetic oligonucleotide
gggaggacgaugcgggccacucuucugcugcuccccagacgacucgcccga

SEQ ID NO: 2930 - RNA, 51 nt, Artificial Sequence
  Description of Artificial Sequence: Synthetic oligonucleotide
gggaggacgaugcgggccuaucgucugauccuccccagacgacucgcccga

SEQ ID NO: 2931 - RNA, 51 nt, Artificial Sequence
  Description of Artificial Sequence: Synthetic oligonucleotide
gggaggacgaugcgggccucuugucugaccuuccccagacgacucgcccga

SEQ ID NO: 2932 - RNA, 51 nt, Artificial Sequence
  Description of Artificial Sequence: Synthetic oligonucleotide
gggaggacgaugcgggccuucgucucuugccuccccagacgacucgcccga

SEQ ID NO: 2933 - RNA, 51 nt, Artificial Sequence
  Description of Artificial Sequence: Synthetic oligonucleotide
gggaggacgaugcgggcguuuucucuguucguccccagacgacucgcccga

SEQ ID NO: 2934 - RNA, 52 nt, Artificial Sequence
  Description of Artificial Sequence: Synthetic oligonucleotide
gggaggacgaugcggguccugucgucugucuguccccagacgacucgcccga

SEQ ID NO: 2935 - RNA, 51 nt, Artificial Sequence
  Description of Artificial Sequence: Synthetic oligonucleotide
gggaggacgaugcgggucgucuuucgucucguccccagacgacucgcccga

SEQ ID NO: 2936 - RNA, 51 nt, Artificial Sequence
  Description of Artificial Sequence: Synthetic oligonucleotide
gggaggacgaugcgggucuuucgucugcaacuccccagacgacucgcccga

SEQ ID NO: 2937 - RNA, 51 nt, Artificial Sequence
  Description of Artificial Sequence: Synthetic oligonucleotide
gggaggacgaugcgguccagucguuuguuugccgccagacgacucgcccga

SEQ ID NO: 2938 - RNA, 51 nt, Artificial Sequence
  Description of Artificial Sequence: Synthetic oligonucleotide
gggaggacgaugcggucccgucgucugcucguccccagacgacucgcccga

SEQ ID NO: 2939 - RNA, 51 nt, Artificial Sequence
  Description of Artificial Sequence: Synthetic oligonucleotide
gggaggacgaugcggucccgucgucuguccguccccagacgacucgcccga

SEQ ID NO: 2940 - RNA, 51 nt, Artificial Sequence
  Description of Artificial Sequence: Synthetic oligonucleotide
gggaggacgaugcgguccuaucgucuauucguccccagacgacucgcccga

SEQ ID NO: 2941 - RNA, 51 nt, Artificial Sequence
  Description of Artificial Sequence: Synthetic oligonucleotide
gggaggacgaugcgguccuggcuugucguucuccccagacgacucgcccga

SEQ ID NO: 2942 - RNA, 51 nt, Artificial Sequence
  Description of Artificial Sequence: Synthetic oligonucleotide
gggaggacgaugcgguccuggcuugucguuguccacagacgacucgcccga

SEQ ID NO: 2943 - RNA, 51 nt, Artificial Sequence
  Description of Artificial Sequence: Synthetic oligonucleotide
gggaggacgaugcgguccuguagucuguucguucccagacgacucgcccga

SEQ ID NO: 2944 - RNA, 51 nt, Artificial Sequence
  Description of Artificial Sequence: Synthetic oligonucleotide
gggaggacgaugcgguccugucgccugcucguccccagacgacucgcccga

SEQ ID NO: 2945 - RNA, 51 nt, Artificial Sequence
  Description of Artificial Sequence: Synthetic oligonucleotide
gggaggacgaugcgguccugucgucucuccguccccagacgacucgcccga

SEQ ID NO: 2946 - RNA, 51 nt, Artificial Sequence
  Description of Artificial Sequence: Synthetic oligonucleotide
gggaggacgaugcgguccugucgucuguucccccccagacgacucgcccga

SEQ ID NO: 2947 - RNA, 51 nt, Artificial Sequence
  Description of Artificial Sequence: Synthetic oligonucleotide
gggaggacgaugcgguccugucgucuguuuguacccagacgacucgcccga

SEQ ID NO: 2948 - RNA, 51 nt, Artificial Sequence
  Description of Artificial Sequence: Synthetic oligonucleotide
gggaggacgaugcgguccugucgucuguuuuuccccagacgacucgcccga

SEQ ID NO: 2949 - RNA, 51 nt, Artificial Sequence
  Description of Artificial Sequence: Synthetic oligonucleotide
gggaggacgaugcgguccugucguuuguucguucccagacgacucgcccga

SEQ ID NO: 2950 - RNA, 51 nt, Artificial Sequence
  Description of Artificial Sequence: Synthetic oligonucleotide
gggaggacgaugcggucgacucgucucaugcuccccagacgacucgcccga

SEQ ID NO: 2951 - RNA, 51 nt, Artificial Sequence
  Description of Artificial Sequence: Synthetic oligonucleotide
gggaggacgaugcggucuugucaucuguucguccccagacgacucgcccga

SEQ ID NO: 2952 - RNA, 50 nt, Artificial Sequence
  Description of Artificial Sequence: Synthetic oligonucleotide
gggaggacgaugcggucuugucgucucgcguccccagacgacucgcccga

SEQ ID NO: 2953 - RNA, 51 nt, Artificial Sequence
  Description of Artificial Sequence: Synthetic oligonucleotide
gggaggacgaugcggucuugucgucuguuaguccccagacgacucgcccga

SEQ ID NO: 2954 - RNA, 51 nt, Artificial Sequence
  Description of Artificial Sequence: Synthetic oligonucleotide
gggaggacgaugcggucuugucgucuguucguccacagacgacucgcccga

SEQ ID NO: 2955 - RNA, 52 nt, Artificial Sequence
  Description of Artificial Sequence: Synthetic oligonucleotide
gggaggacgaugcggugacucgucuguuuucguccccagacgacucgcccga

SEQ ID NO: 2956 - RNA, 51 nt, Artificial Sequence
  Description of Artificial Sequence: Synthetic oligonucleotide
gggaggacgaugcggugucugucgucugcgcuccccagacgacucgcccga

SEQ ID NO: 2957 - RNA, 52 nt, Artificial Sequence
  Description of Artificial Sequence: Synthetic oligonucleotide
gggaggacgaugcgguuuggggucuuucccgugccccagacgacucgcccga

SEQ ID NO: 2958 - RNA, 51 nt, Artificial Sequence
  Description of Artificial Sequence: Synthetic oligonucleotide
gggaggacgaugcgguuugggguuuuaccgugccccagacgacucgcccga

SEQ ID NO: 2959 - RNA, 50 nt, Artificial Sequence
  Description of Artificial Sequence: Synthetic oligonucleotide
gggaggacgaugcgguuugggguuuuccgugccccagacgacucgcccga

SEQ ID NO: 2960 - RNA, 51 nt, Artificial Sequence
  Description of Artificial Sequence: Synthetic oligonucleotide
gggaggacgaugcgguugggguuuuucccgugccccagacgacucgcccga

SEQ ID NO: 2961 - RNA, 51 nt, Artificial Sequence
  Description of Artificial Sequence: Synthetic oligonucleotide
gggaggacgaugcgguuugggguuuucccgucccccagacgacucgcccga

SEQ ID NO: 2962 - RNA, 52 nt, Artificial Sequence
  Description of Artificial Sequence: Synthetic oligonucleotide
gggaggacgaugcgguuugggguuuuucccguaccccagacgacucgcccga

SEQ ID NO: 2963 - RNA, 51 nt, Artificial Sequence
  Description of Artificial Sequence: Synthetic oligonucleotide
gggaggacgaugcgguuugggguauucccgugccccagacgacucgcccga

SEQ ID NO: 2964 - RNA, 51 nt, Artificial Sequence
  Description of Artificial Sequence: Synthetic oligonucleotide
gggaggacgaugcggaccugucgucuguuccuccccagacgacucgcccga

SEQ ID NO: 2965 - RNA, 51 nt, Artificial Sequence
  Description of Artificial Sequence: Synthetic oligonucleotide
gggaggacgaugcggauugggguuuucccgugccccagacgacucgcccga

SEQ ID NO: 2966 - RNA, 51 nt, Artificial Sequence
  Description of Artificial Sequence: Synthetic oligonucleotide
gggaggacgaugcggcacugucgucuguucguccccagacgacucgcccga

SEQ ID NO: 2967 - RNA, 50 nt, Artificial Sequence
  Description of Artificial Sequence: Synthetic oligonucleotide
gggaggacgaugcggccugucgucuuuucguccccagacgacucgcccga

SEQ ID NO: 2968 - RNA, 51 nt, Artificial Sequence
  Description of Artificial Sequence: Synthetic oligonucleotide
gggaggacgaugcggccugucuucugguucguccccagacgacucgcccga

SEQ ID NO: 2969 - RNA, 50 nt, Artificial Sequence
  Description of Artificial Sequence: Synthetic oligonucleotide
gggaggacgaugcggcgacucggucugcacuccccagacgacucgcccga

SEQ ID NO: 2970 - RNA, 51 nt, Artificial Sequence
  Description of Artificial Sequence: Synthetic oligonucleotide
gggaggacgaugcggcgagcuucugguaucguccccagacgacucgcccga

SEQ ID NO: 2971 - RNA, 51 nt, Artificial Sequence
  Description of Artificial Sequence: Synthetic oligonucleotide
gggaggacgaugcggcgaguuccucugaucguccccagacgacucgcccga

SEQ ID NO: 2972 - RNA, 51 nt, Artificial Sequence
  Description of Artificial Sequence: Synthetic oligonucleotide
gggaggacgaugcggcgcgucuucugcucacuccccagacgacucgcccga

SEQ ID NO: 2973 - RNA, 51 nt, Artificial Sequence
  Description of Artificial Sequence: Synthetic oligonucleotide
gggaggacgaugcggcguacucgucugcucuuccccagacgacucgcccga

SEQ ID NO: 2974 - RNA, 50 nt, Artificial Sequence
  Description of Artificial Sequence: Synthetic oligonucleotide
gggaggacgaugcggcguuuccucugguucgucccagacgacucgcccga

SEQ ID NO: 2975 - RNA, 51 nt, Artificial Sequence
  Description of Artificial Sequence: Synthetic oligonucleotide
gggaggacgaugcggcguuuucucugguucguccccagacgacucgcccga

SEQ ID NO: 2976 - RNA, 51 nt, Artificial Sequence
  Description of Artificial Sequence: Synthetic oligonucleotide
gggaggacgaugcgggccucucgucugugccuccccagacgacucgcccga

SEQ ID NO: 2977 - RNA, 51 nt, Artificial Sequence
  Description of Artificial Sequence: Synthetic oligonucleotide
gggaggacgaugcgggccucugucgucacuguccccagacgacucgcccga

SEQ ID NO: 2978 - RNA, 50 nt, Artificial Sequence
  Description of Artificial Sequence: Synthetic oligonucleotide
gggaggacgaugcgggcguuuccucuguucgucccagacgacucgcccga

SEQ ID NO: 2979 - RNA, 51 nt, Artificial Sequence
  Description of Artificial Sequence: Synthetic oligonucleotide
gggaggacgaugcgggcguuucuucuguucguccccagacgacucgcccga

SEQ ID NO: 2980 - RNA, 51 nt, Artificial Sequence
  Description of Artificial Sequence: Synthetic oligonucleotide
gggaggacgaugcgggcuuuucgucuacggucccccagacgacucgcccga

SEQ ID NO: 2981 - RNA, 51 nt, Artificial Sequence
  Description of Artificial Sequence: Synthetic oligonucleotide
gggaggacgaugcgggguuucgucugccaccuccccagacgacucgcccga

SEQ ID NO: 2982 - RNA, 52 nt, Artificial Sequence
  Description of Artificial Sequence: Synthetic oligonucleotide
gggaggacgaugcgggucuugucgucuguucguccccagacgacucgcccga

SEQ ID NO: 2983 - RNA, 51 nt, Artificial Sequence
  Description of Artificial Sequence: Synthetic oligonucleotide
gggaggacgaugcgggugccucgucugcucuuccccagacgacucgcccga

SEQ ID NO: 2984 - RNA, 51 nt, Artificial Sequence
  Description of Artificial Sequence: Synthetic oligonucleotide
gggaggacgaugcggucaugucgucuguuagucaccagacgacucgcccga

SEQ ID NO: 2985 - RNA, 51 nt, Artificial Sequence
  Description of Artificial Sequence: Synthetic oligonucleotide
gggaggacgaugcggucaugucgucuguucgucaccagacgacucgcccga

SEQ ID NO: 2986 - RNA, 51 nt, Artificial Sequence
  Description of Artificial Sequence: Synthetic oligonucleotide
gggaggacgaugcggucccgucgccuguucguccccagacgacucgcccga

SEQ ID NO: 2987 - RNA, 51 nt, Artificial Sequence
  Description of Artificial Sequence: Synthetic oligonucleotide
gggaggacgaugcggucccgucgucuguucgcccccagacgacucgcccga

SEQ ID NO: 2988 - RNA, 52 nt, Artificial Sequence
  Description of Artificial Sequence: Synthetic oligonucleotide
gggaggacgaugcggucccugucgucuguucguccccagacgacucgcccga

SEQ ID NO: 2989 - RNA, 51 nt, Artificial Sequence
  Description of Artificial Sequence: Synthetic oligonucleotide
gggaggacgaugcgguccugccgucuguucgcccccagacgacucgcccga

SEQ ID NO: 2990 - RNA, 51 nt, Artificial Sequence
  Description of Artificial Sequence: Synthetic oligonucleotide
gggaggacgaugcgguccuggcuugucguugugcccagacgacucgcccga

SEQ ID NO: 2991 - RNA, 51 nt, Artificial Sequence
  Description of Artificial Sequence: Synthetic oligonucleotide
gggaggacgaugcgguccugucgucugucccuccccagacgacucgcccga

SEQ ID NO: 2992 - RNA, 51 nt, Artificial Sequence
  Description of Artificial Sequence: Synthetic oligonucleotide
gggaggacgaugcgguccugucgucuguucgcuuccagacgacucgcccga

SEQ ID NO: 2993 - RNA, 51 nt, Artificial Sequence
  Description of Artificial Sequence: Synthetic oligonucleotide
gggaggacgaugcggucgucucgucugccgcuccccagacgacucgcccga

SEQ ID NO: 2994 - RNA, 51 nt, Artificial Sequence
  Description of Artificial Sequence: Synthetic oligonucleotide
gggaggacgaugcggucucacauuuucccggugugcagacgacucgcccga

SEQ ID NO: 2995 - RNA, 51 nt, Artificial Sequence
  Description of Artificial Sequence: Synthetic oligonucleotide
gggaggacgaugcggucuugucgucuguucuuccccagacgacucgcccga

SEQ ID NO: 2996 - RNA, 51 nt, Artificial Sequence
  Description of Artificial Sequence: Synthetic oligonucleotide
gggaggacgaugcggugcggucucugauaccuccccagacgacucgcccga

SEQ ID NO: 2997 - RNA, 51 nt, Artificial Sequence
  Description of Artificial Sequence: Synthetic oligonucleotide
gggaggacgaugcggugcugucgucugcucguccccagacgacucgcccga

SEQ ID NO: 2998 - RNA, 51 nt, Artificial Sequence
  Description of Artificial Sequence: Synthetic oligonucleotide
gggaggacgaugcggugcugucgucuguuccuccccagacgacucgcccga

SEQ ID NO: 2999 - RNA, 51 nt, Artificial Sequence
  Description of Artificial Sequence: Synthetic oligonucleotide
gggaggacgaugcggugucucgucuggagccgcaccagacgacucgcccga

SEQ ID NO: 3000 - RNA, 51 nt, Artificial Sequence
  Description of Artificial Sequence: Synthetic oligonucleotide
gggaggacgaugcgguuguaguugucugcgcuccccagacgacucgcccga

SEQ ID NO: 3001 - RNA, 51 nt, Artificial Sequence
  Description of Artificial Sequence: Synthetic oligonucleotide
gggaggacgaugcgguuucaguagugggccugcugcagacgacucgcccga

SEQ ID NO: 3002 - RNA, 51 nt, Artificial Sequence
  Description of Artificial Sequence: Synthetic oligonucleotide
gggaggacgaugcggccaguuuaccuuacacucgccagacgacucgcccga

SEQ ID NO: 3003 - RNA, 51 nt, Artificial Sequence
  Description of Artificial Sequence: Synthetic oligonucleotide
gggaggacgaugcggcccgucgucuguucacuccccagacgacucgcccga

SEQ ID NO: 3004 - RNA, 51 nt, Artificial Sequence
  Description of Artificial Sequence: Synthetic oligonucleotide
gggaggacgaugcggcccugucgucugaucguccccagacgacucgcccga

SEQ ID NO: 3005 - RNA, 51 nt, Artificial Sequence
  Description of Artificial Sequence: Synthetic oligonucleotide
gggaggacgaugcggccgucguucuguagccuccccagacgacucgcccga

SEQ ID NO: 3006 - RNA, 51 nt, Artificial Sequence
  Description of Artificial Sequence: Synthetic oligonucleotide
gggaggacgaugcggccugucgucauuugcguccccagacgacucgcccga

SEQ ID NO: 3007 - RNA, 51 nt, Artificial Sequence
  Description of Artificial Sequence: Synthetic oligonucleotide
gggaggacgaugcggcgacuccucuguuuucuccccagacgacucgcccga

SEQ ID NO: 3008 - RNA, 51 nt, Artificial Sequence
  Description of Artificial Sequence: Synthetic oligonucleotide
gggaggacgaugcggcgacucguucuguucguccccagacgacucgcccga

SEQ ID NO: 3009 - RNA, 51 nt, Artificial Sequence
  Description of Artificial Sequence: Synthetic oligonucleotide
gggaggacgaugcggcgauuccucugacucguccccagacgacucgcccga

SEQ ID NO: 3010 - RNA, 51 nt, Artificial Sequence
  Description of Artificial Sequence: Synthetic oligonucleotide
gggaggacgaugcggcgcuucuucuggagccuccccagacgacucgcccga

SEQ ID NO: 3011 - RNA, 51 nt, Artificial Sequence
  Description of Artificial Sequence: Synthetic oligonucleotide
gggaggacgaugcggcgggccuucuguuucguccccagacgacucgcccga

SEQ ID NO: 3012 - RNA, 51 nt, Artificial Sequence
  Description of Artificial Sequence: Synthetic oligonucleotide
gggaggacgaugcggcguuacucgucuguggccgccagacgacucgcccga

SEQ ID NO: 3013 - RNA, 51 nt, Artificial Sequence
  Description of Artificial Sequence: Synthetic oligonucleotide
gggaggacgaugcggcguuucagucuguagcuccccagacgacucgcccga

SEQ ID NO: 3014 - RNA, 51 nt, Artificial Sequence
  Description of Artificial Sequence: Synthetic oligonucleotide
gggaggacgaugcggcguuuccucugguuuguccccagacgacucgcccga

SEQ ID NO: 3015 - RNA, 51 nt, Artificial Sequence
  Description of Artificial Sequence: Synthetic oligonucleotide
gggaggacgaugcggcguuucgucuucugucaccccagacgacucgcccga

SEQ ID NO: 3016 - RNA, 51 nt, Artificial Sequence
  Description of Artificial Sequence: Synthetic oligonucleotide
gggaggacgaugcggcuagucuucugauucguccccagacgacucgcccga

SEQ ID NO: 3017 - RNA, 51 nt, Artificial Sequence
  Description of Artificial Sequence: Synthetic oligonucleotide
gggaggacgaugcgggcaaucguucugacccuccccagacgacucgcccga

SEQ ID NO: 3018 - RNA, 51 nt, Artificial Sequence
  Description of Artificial Sequence: Synthetic oligonucleotide
gggaggacgaugcgggcauuucguucugaucuccccagacgacucgcccga

SEQ ID NO: 3019 - RNA, 52 nt, Artificial Sequence
  Description of Artificial Sequence: Synthetic oligonucleotide
gggaggacgaugcgggcccguucgucuuuccucccccagacgacucgcccga

SEQ ID NO: 3020 - RNA, 51 nt, Artificial Sequence
  Description of Artificial Sequence: Synthetic oligonucleotide
gggaggacgaugcgggcccuucgaucugcgcuccccagacgacucgcccga

SEQ ID NO: 3021 - RNA, 51 nt, Artificial Sequence
  Description of Artificial Sequence: Synthetic oligonucleotide
gggaggacgaugcgggccgucguucuuuucguccccagacgacucgcccga

SEQ ID NO: 3022 - RNA, 51 nt, Artificial Sequence
  Description of Artificial Sequence: Synthetic oligonucleotide
gggaggacgaugcgggccucucuucuggaccuccccagacgacucgcccga

SEQ ID NO: 3023 - RNA, 52 nt, Artificial Sequence
  Description of Artificial Sequence: Synthetic oligonucleotide
gggaggacgaugcgggccuucucgucuguugucccccagacgacucgcccga

SEQ ID NO: 3024 - RNA, 51 nt, Artificial Sequence
  Description of Artificial Sequence: Synthetic oligonucleotide
gggaggacgaugcgggccuuucgucuuuacguccccagacgacucgcccga

SEQ ID NO: 3025 - RNA, 51 nt, Artificial Sequence
  Description of Artificial Sequence: Synthetic oligonucleotide
gggaggacgaugcgggcgucucuucugucccuccccagacgacucgcccga

SEQ ID NO: 3026 - RNA, 51 nt, Artificial Sequence
  Description of Artificial Sequence: Synthetic oligonucleotide
gggaggacgaugcgggcguuuccucuguucgucuccagacgacucgcccga

SEQ ID NO: 3027 - RNA, 51 nt, Artificial Sequence
  Description of Artificial Sequence: Synthetic oligonucleotide
gggaggacgaugcgggcguuuccucuguucguuuccagacgacucgcccga

SEQ ID NO: 3028 - RNA, 51 nt, Artificial Sequence
  Description of Artificial Sequence: Synthetic oligonucleotide
gggaggacgaugcgggcucgagcgucuuucguccccagacgacucgcccga

SEQ ID NO: 3029 - RNA, 50 nt, Artificial Sequence
  Description of Artificial Sequence: Synthetic oligonucleotide
gggaggacgaugcgggcugucuucuguucguccccagacgacucgcccga

SEQ ID NO: 3030 - RNA, 51 nt, Artificial Sequence
  Description of Artificial Sequence: Synthetic oligonucleotide
gggaggacgaugcgggcuuuuucgucuugccuccccagacgacucgcccga

SEQ ID NO: 3031 - RNA, 52 nt, Artificial Sequence
  Description of Artificial Sequence: Synthetic oligonucleotide
gggaggacgaugcggguccugacgucuguucguccccagacgacucgcccga

SEQ ID NO: 3032 - RNA, 52 nt, Artificial Sequence
  Description of Artificial Sequence: Synthetic oligonucleotide
gggaggacgaugcggguccuguccucuguucguccccagacgacucgcccga

SEQ ID NO: 3033 - RNA, 52 nt, Artificial Sequence
  Description of Artificial Sequence: Synthetic oligonucleotide
gggaggacgaugcggguccugucgucaguucguccccagacgacucgcccga

SEQ ID NO: 3034 - RNA, 52 nt, Artificial Sequence
  Description of Artificial Sequence: Synthetic oligonucleotide
gggaggacgaugcggguccugucgucuguucgaccccagacgacucgcccga

SEQ ID NO: 3035 - RNA, 51 nt, Artificial Sequence
  Description of Artificial Sequence: Synthetic oligonucleotide
gggaggacgaugcggguccugucgucuuucguccccagacgacucgcccga

SEQ ID NO: 3036 - RNA, 51 nt, Artificial Sequence
  Description of Artificial Sequence: Synthetic oligonucleotide
gggaggacgaugcggguccuuucgucuguggccgccagacgacucgcccga

SEQ ID NO: 3037 - RNA, 51 nt, Artificial Sequence
  Description of Artificial Sequence: Synthetic oligonucleotide
gggaggacgaugcggguugaaucgucucgcguccccagacgacucgcccga

SEQ ID NO: 3038 - RNA, 51 nt, Artificial Sequence
  Description of Artificial Sequence: Synthetic oligonucleotide
gggaggacgaugcggucaugucgucuguucguucccagacgacucgcccga

SEQ ID NO: 3039 - RNA, 51 nt, Artificial Sequence
  Description of Artificial Sequence: Synthetic oligonucleotide
gggaggacgaugcggucccgucgucuguucguucccagacgacucgcccga

SEQ ID NO: 3040 - RNA, 51 nt, Artificial Sequence
  Description of Artificial Sequence: Synthetic oligonucleotide
gggaggacgaugcgguccuaucgucuguucgcccccagacgacucgcccga

SEQ ID NO: 3041 - RNA, 51 nt, Artificial Sequence
  Description of Artificial Sequence: Synthetic oligonucleotide
gggaggacgaugcgguccucgcuugucguuguccccagacgacucgcccga

SEQ ID NO: 3042 - RNA, 51 nt, Artificial Sequence
  Description of Artificial Sequence: Synthetic oligonucleotide
gggaggacgaugcgguccuggcuucucguuguccccagacgacucgcccga

SEQ ID NO: 3043 - RNA, 48 nt, Artificial Sequence
  Description of Artificial Sequence: Synthetic oligonucleotide
gggaggacgaugcgguccuggcuugucguucccagacgacucgcccga

SEQ ID NO: 3044 - RNA, 51 nt, Artificial Sequence
  Description of Artificial Sequence: Synthetic oligonucleotide
gggaggacgaugcgguccugucguauguucguacacagacgacucgcccga

SEQ ID NO: 3045 - RNA, 51 nt, Artificial Sequence
  Description of Artificial Sequence: Synthetic oligonucleotide
gggaggacgaugcgguccugucguauguucguucccagacgacucgcccga

SEQ ID NO: 3046 - RNA, 51 nt, Artificial Sequence
  Description of Artificial Sequence: Synthetic oligonucleotide
gggaggacgaugcgguccugucguccguucguucccagacgacucgcccga

SEQ ID NO: 3047 - RNA, 51 nt, Artificial Sequence
  Description of Artificial Sequence: Synthetic oligonucleotide
gggaggacgaugcgguccugucgucugcucuuccccagacgacucgcccga

SEQ ID NO: 3048 - RNA, 53 nt, Artificial Sequence
  Description of Artificial Sequence: Synthetic oligonucleotide
gggaggacgaugcgguccugucgucuguucguccccccagacgacucgcccga

SEQ ID NO: 3049 - RNA, 50 nt, Artificial Sequence
  Description of Artificial Sequence: Synthetic oligonucleotide
gggaggacgaugcgguccugucgucuguuguucccagacgacucgcccga

SEQ ID NO: 3050 - RNA, 51 nt, Artificial Sequence
  Description of Artificial Sequence: Synthetic oligonucleotide
gggaggacgaugcgguccugucgucuucucguccccagacgacucgcccga

SEQ ID NO: 3051 - RNA, 51 nt, Artificial Sequence
  Description of Artificial Sequence: Synthetic oligonucleotide
gggaggacgaugcggucgaucugguuuugccgcgccagacgacucgcccga

SEQ ID NO: 3052 - RNA, 51 nt, Artificial Sequence
  Description of Artificial Sequence: Synthetic oligonucleotide
gggaggacgaugcggucuugucgucucuucguccccagacgacucgcccga

SEQ ID NO: 3053 - RNA, 51 nt, Artificial Sequence
  Description of Artificial Sequence: Synthetic oligonucleotide
gggaggacgaugcggucuugucgucuguucgucuccagacgacucgcccga

SEQ ID NO: 3054 - RNA, 51 nt, Artificial Sequence
  Description of Artificial Sequence: Synthetic oligonucleotide
gggaggacgaugcggucuugucgucuguugguccccagacgacucgcccga

SEQ ID NO: 3055 - RNA, 51 nt, Artificial Sequence
  Description of Artificial Sequence: Synthetic oligonucleotide
gggaggacgaugcggugcugucgucuguucguuuccagacgacucgcccga

SEQ ID NO: 3056 - RNA, 51 nt, Artificial Sequence
  Description of Artificial Sequence: Synthetic oligonucleotide
gggaggacgaugcgguuuaggguuuucccgugccccagacgacucgcccga

SEQ ID NO: 3057 - RNA, 49 nt, Artificial Sequence
  Description of Artificial Sequence: Synthetic oligonucleotide
gggaggacgaugcgguccugucgucuguguccccagacgacucgcccga

SEQ ID NO: 3058 - RNA, 51 nt, Artificial Sequence
  Description of Artificial Sequence: Synthetic oligonucleotide
gggaggacgaugcggucuucuggguuuuggcgccccagacgacucgcccga

SEQ ID NO: 3059 - RNA, 49 nt, Artificial Sequence
  Description of Artificial Sequence: Synthetic oligonucleotide
gggaggacgaugcgguuugggguucccgugccccagacgacucgcccga

SEQ ID NO: 3060 - RNA, 52 nt, Artificial Sequence
  Description of Artificial Sequence: Synthetic oligonucleotide
gggaggacgaugcgguuugggguucuucccgugccccagacgacucgcccga

SEQ ID NO: 3061 - RNA, 51 nt, Artificial Sequence
  Description of Artificial Sequence: Synthetic oligonucleotide
gggaggacgaugcgguuugggguuuucacgugccccagacgacucgcccga

SEQ ID NO: 3062 - RNA, 51 nt, Artificial Sequence
  Description of Artificial Sequence: Synthetic oligonucleotide
gggaggacgaugcggccuucgucugguuucugccccagacgacucgcccga

SEQ ID NO: 3063 - RNA, 51 nt, Artificial Sequence
  Description of Artificial Sequence: Synthetic oligonucleotide
gggaggacgaugcggucugguguuuguucccgcgccagacgacucgcccga

SEQ ID NO: 3064 - RNA, 51 nt, Artificial Sequence
  Description of Artificial Sequence: Synthetic oligonucleotide
gggaggacgaugcgguuugggguuacuucccgccccagacgacucgcccga

SEQ ID NO: 3065 - RNA, 51 nt, Artificial Sequence
  Description of Artificial Sequence: Synthetic oligonucleotide
gggaggacgaugcgguuugggguuuccuuccgccccagacgacucgcccga

SEQ ID NO: 3066 - RNA, 51 nt, Artificial Sequence
  Description of Artificial Sequence: Synthetic oligonucleotide
gggaggacgaugcggucucacagaucccaccugugcagacgacucgcccga

SEQ ID NO: 3067 - RNA, 51 nt, Artificial Sequence
  Description of Artificial Sequence: Synthetic oligonucleotide
gggaggacgaugcggaacgagucguuuucgcaccccagacgacucgcccga

SEQ ID NO: 3068 - RNA, 51 nt, Artificial Sequence
  Description of Artificial Sequence: Synthetic oligonucleotide
gggaggacgaugcggaccuguagucuguucguccccagacgacucgcccga

SEQ ID NO: 3069 - RNA, 51 nt, Artificial Sequence
  Description of Artificial Sequence: Synthetic oligonucleotide
gggaggacgaugcggccacucgucugucaccuccccagacgacucgcccga

SEQ ID NO: 3070 - RNA, 51 nt, Artificial Sequence
  Description of Artificial Sequence: Synthetic oligonucleotide
gggaggacgaugcggccaguccucuguuuccuccccagacgacucgcccga

SEQ ID NO: 3071 - RNA, 51 nt, Artificial Sequence
  Description of Artificial Sequence: Synthetic oligonucleotide
gggaggacgaugcggcccgucgucugcuucuuccccagacgacucgcccga

SEQ ID NO: 3072 - RNA, 51 nt, Artificial Sequence
  Description of Artificial Sequence: Synthetic oligonucleotide
gggaggacgaugcggcccucucgucuguucguccccagacgacucgcccga

SEQ ID NO: 3073 - RNA, 51 nt, Artificial Sequence
  Description of Artificial Sequence: Synthetic oligonucleotide
gggaggacgaugcggcccugucguauguucguccccagacgacucgcccga

SEQ ID NO: 3074 - RNA, 51 nt, Artificial Sequence
  Description of Artificial Sequence: Synthetic oligonucleotide
gggaggacgaugcggcccugucgucuguacguccccagacgacucgcccga

SEQ ID NO: 3075 - RNA, 51 nt, Artificial Sequence
  Description of Artificial Sequence: Synthetic oligonucleotide
gggaggacgaugcggcccugucgucuuuucguccccagacgacucgcccga

SEQ ID NO: 3076 - RNA, 51 nt, Artificial Sequence
  Description of Artificial Sequence: Synthetic oligonucleotide
gggaggacgaugcggccgaguucuucuguacuccccagacgacucgcccga

SEQ ID NO: 3077 - RNA, 51 nt, Artificial Sequence
  Description of Artificial Sequence: Synthetic oligonucleotide
gggaggacgaugcggccguguuguucuggccuccccagacgacucgcccga

SEQ ID NO: 3078 - RNA, 51 nt, Artificial Sequence
  Description of Artificial Sequence: Synthetic oligonucleotide
gggaggacgaugcggccugucgucucuucccuccccagacgacucgcccga

SEQ ID NO: 3079 - RNA, 51 nt, Artificial Sequence
  Description of Artificial Sequence: Synthetic oligonucleotide
gggaggacgaugcggcgacucgucaauucccuccccagacgacucgcccga

SEQ ID NO: 3080 - RNA, 51 nt, Artificial Sequence
  Description of Artificial Sequence: Synthetic oligonucleotide
gggaggacgaugcggcgacucuucugugcgcuccccagacgacucgcccga

SEQ ID NO: 3081 - RNA, 51 nt, Artificial Sequence
  Description of Artificial Sequence: Synthetic oligonucleotide
gggaggacgaugcggcgacuucgucugcaccuccccagacgacucgcccga

SEQ ID NO: 3082 - RNA, 51 nt, Artificial Sequence
  Description of Artificial Sequence: Synthetic oligonucleotide
gggaggacgaugcggcguacucgucugcugcuccccagacgacucgcccga

SEQ ID NO: 3083 - RNA, 51 nt, Artificial Sequence
  Description of Artificial Sequence: Synthetic oligonucleotide
gggaggacgaugcggcguuuccucugguucgucuccagacgacucgcccga

SEQ ID NO: 3084 - RNA, 51 nt, Artificial Sequence
  Description of Artificial Sequence: Synthetic oligonucleotide
gggaggacgaugcggcguuucucgucugcacuccccagacgacucgcccga

SEQ ID NO: 3085 - RNA, 51 nt, Artificial Sequence
  Description of Artificial Sequence: Synthetic oligonucleotide
gggaggacgaugcggcguuucugucugacacuccccagacgacucgcccga

SEQ ID NO: 3086 - RNA, 51 nt, Artificial Sequence
  Description of Artificial Sequence: Synthetic oligonucleotide
gggaggacgaugcgggccacucgucuuuucguccccagacgacucgcccga

SEQ ID NO: 3087 - RNA, 51 nt, Artificial Sequence
  Description of Artificial Sequence: Synthetic oligonucleotide
gggaggacgaugcgggcccgucguucuuaccuccccagacgacucgcccga

SEQ ID NO: 3088 - RNA, 51 nt, Artificial Sequence
  Description of Artificial Sequence: Synthetic oligonucleotide
gggaggacgaugcgggccucgucguuuguucuccccagacgacucgcccga

SEQ ID NO: 3089 - RNA, 51 nt, Artificial Sequence
  Description of Artificial Sequence: Synthetic oligonucleotide
gggaggacgaugcgggccucucgucugacccuccccagacgacucgcccga

SEQ ID NO: 3090 - RNA, 51 nt, Artificial Sequence
  Description of Artificial Sequence: Synthetic oligonucleotide
gggaggacgaugcgggccucucguucugaccuccccagacgacucgcccga

SEQ ID NO: 3091 - RNA, 53 nt, Artificial Sequence
  Description of Artificial Sequence: Synthetic oligonucleotide
gggaggacgaugcgggccuucucgucuguuguucccccagacgacucgcccga

SEQ ID NO: 3092 - RNA, 51 nt, Artificial Sequence
  Description of Artificial Sequence: Synthetic oligonucleotide
gggaggacgaugcgggcgccuucguuuguacuccccagacgacucgcccga

SEQ ID NO: 3093 - RNA, 51 nt, Artificial Sequence
  Description of Artificial Sequence: Synthetic oligonucleotide
gggaggacgaugcgggcguuuccucuguuuguccccagacgacucgcccga

SEQ ID NO: 3094 - RNA, 51 nt, Artificial Sequence
  Description of Artificial Sequence: Synthetic oligonucleotide
gggaggacgaugcgggcucucgucguuugccuccccagacgacucgcccga

SEQ ID NO: 3095 - RNA, 52 nt, Artificial Sequence
  Description of Artificial Sequence: Synthetic oligonucleotide
gggaggacgaugcgggucaugucgucuguucguccccagacgacucgcccga

SEQ ID NO: 3096 - RNA, 52 nt, Artificial Sequence
  Description of Artificial Sequence: Synthetic oligonucleotide
gggaggacgaugcggguccugucgucuguacguccccagacgacucgcccga

SEQ ID NO: 3097 - RNA, 52 nt, Artificial Sequence
  Description of Artificial Sequence: Synthetic oligonucleotide
gggaggacgaugcggguccugucgucuguucgucaccagacgacucgcccga

SEQ ID NO: 3098 - RNA, 52 nt, Artificial Sequence
  Description of Artificial Sequence: Synthetic oligonucleotide
gggaggacgaugcggguccugucgucuguucgugcccagacgacucgcccga

SEQ ID NO: 3099 - RNA, 51 nt, Artificial Sequence
  Description of Artificial Sequence: Synthetic oligonucleotide
gggaggacgaugcgggucugucgucucuacguccccagacgacucgcccga

SEQ ID NO: 3100 - RNA, 51 nt, Artificial Sequence
  Description of Artificial Sequence: Synthetic oligonucleotide
gggaggacgaugcgggugacucucuguaaccuccccagacgacucgcccga

SEQ ID NO: 3101 - RNA, 52 nt, Artificial Sequence
  Description of Artificial Sequence: Synthetic oligonucleotide
gggaggacgaugcggguguuuucgucucuucguccccagacgacucgcccga

SEQ ID NO: 3102 - RNA, 51 nt, Artificial Sequence
  Description of Artificial Sequence: Synthetic oligonucleotide
gggaggacgaugcggguuacucgucugccgcuccccagacgacucgcccga

SEQ ID NO: 3103 - RNA, 51 nt, Artificial Sequence
  Description of Artificial Sequence: Synthetic oligonucleotide
gggaggacgaugcggguuccucgucugucccuccccagacgacucgcccga

SEQ ID NO: 3104 - RNA, 51 nt, Artificial Sequence
  Description of Artificial Sequence: Synthetic oligonucleotide
gggaggacgaugcgguacugucgucuguucguacacagacgacucgcccga

SEQ ID NO: 3105 - RNA, 51 nt, Artificial Sequence
  Description of Artificial Sequence: Synthetic oligonucleotide
gggaggacgaugcggucagucgucuacuucguccccagacgacucgcccga

SEQ ID NO: 3106 - RNA, 51 nt, Artificial Sequence
  Description of Artificial Sequence: Synthetic oligonucleotide
gggaggacgaugcggucauguagucuguucguacccagacgacucgcccga

SEQ ID NO: 3107 - RNA, 51 nt, Artificial Sequence
  Description of Artificial Sequence: Synthetic oligonucleotide
gggaggacgaugcggucaugucgucuguucgaccccagacgacucgcccga

SEQ ID NO: 3108 - RNA, 51 nt, Artificial Sequence
  Description of Artificial Sequence: Synthetic oligonucleotide
gggaggacgaugcggucccgucgucucuucguccccagacgacucgcccga

SEQ ID NO: 3109 - RNA, 51 nt, Artificial Sequence
  Description of Artificial Sequence: Synthetic oligonucleotide
gggaggacgaugcgguccuaucgucuguuuguccccagacgacucgcccga

SEQ ID NO: 3110 - RNA, 51 nt, Artificial Sequence
  Description of Artificial Sequence: Synthetic oligonucleotide
gggaggacgaugcgguccucucgccuguucguccccagacgacucgcccga

SEQ ID NO: 3111 - RNA, 51 nt, Artificial Sequence
  Description of Artificial Sequence: Synthetic oligonucleotide
gggaggacgaugcgguccuggcuugucauuguccccagacgacucgcccga

SEQ ID NO: 3112 - RNA, 51 nt, Artificial Sequence
  Description of Artificial Sequence: Synthetic oligonucleotide
gggaggacgaugcgguccuggcuuguccuuguccccagacgacucgcccga

SEQ ID NO: 3113 - RNA, 51 nt, Artificial Sequence
  Description of Artificial Sequence: Synthetic oligonucleotide
gggaggacgaugcgguccuggcuugucguuguccucagacgacucgcccga

SEQ ID NO: 3114 - RNA, 51 nt, Artificial Sequence
  Description of Artificial Sequence: Synthetic oligonucleotide
gggaggacgaugcgguccuguaguauguuaguccccagacgacucgcccga

SEQ ID NO: 3115 - RNA, 50 nt, Artificial Sequence
  Description of Artificial Sequence: Synthetic oligonucleotide
gggaggacgaugcgguccugucgccuguucgucccagacgacucgcccga

SEQ ID NO: 3116 - RNA, 51 nt, Artificial Sequence
  Description of Artificial Sequence: Synthetic oligonucleotide
gggaggacgaugcgguccugucgguuguucguccccagacgacucgcccga

SEQ ID NO: 3117 - RNA, 51 nt, Artificial Sequence
  Description of Artificial Sequence: Synthetic oligonucleotide
gggaggacgaugcgguccugucgucuauucgcccccagacgacucgcccga

SEQ ID NO: 3118 - RNA, 51 nt, Artificial Sequence
  Description of Artificial Sequence: Synthetic oligonucleotide
gggaggacgaugcgguccugucgucugcucgcccccagacgacucgcccga

SEQ ID NO: 3119 - RNA, 50 nt, Artificial Sequence
  Description of Artificial Sequence: Synthetic oligonucleotide
gggaggacgaugcgguccugucgucugucuuccccagacgacucgcccga

SEQ ID NO: 3120 - RNA, 51 nt, Artificial Sequence
  Description of Artificial Sequence: Synthetic oligonucleotide
gggaggacgaugcgguccugucgucuguuaguucccagacgacucgcccga

SEQ ID NO: 3121 - RNA, 51 nt, Artificial Sequence
  Description of Artificial Sequence: Synthetic oligonucleotide
gggaggacgaugcgguccugucgucuguucgacaccagacgacucgcccga

SEQ ID NO: 3122 - RNA, 50 nt, Artificial Sequence
  Description of Artificial Sequence: Synthetic oligonucleotide
gggaggacgaugcgguccugucgucuguucgucucagacgacucgcccga

SEQ ID NO: 3123 - RNA, 48 nt, Artificial Sequence
  Description of Artificial Sequence: Synthetic oligonucleotide
gggaggacgaugcgguccugucgucuguucuccagacgacucgcccga

SEQ ID NO: 3124 - RNA, 51 nt, Artificial Sequence
  Description of Artificial Sequence: Synthetic oligonucleotide
gggaggacgaugcgguccugucgucuguucucccccagacgacucgcccga

SEQ ID NO: 3125 - RNA, 51 nt, Artificial Sequence
  Description of Artificial Sequence: Synthetic oligonucleotide
gggaggacgaugcgguccugucgucuguuugucaccagacgacucgcccga

SEQ ID NO: 3126 - RNA, 51 nt, Artificial Sequence
  Description of Artificial Sequence: Synthetic oligonucleotide
gggaggacgaugcgguccugucgucuguuuguccacagacgacucgcccga

SEQ ID NO: 3127 - RNA, 51 nt, Artificial Sequence
  Description of Artificial Sequence: Synthetic oligonucleotide
gggaggacgaugcgguccugucgucuuuucuuccccagacgacucgcccga

SEQ ID NO: 3128 - RNA, 51 nt, Artificial Sequence
  Description of Artificial Sequence: Synthetic oligonucleotide
gggaggacgaugcggucgagcgucuucuugucccccagacgacucgcccga

SEQ ID NO: 3129 - RNA, 51 nt, Artificial Sequence
  Description of Artificial Sequence: Synthetic oligonucleotide
gggaggacgaugcggucggcucgucugcuacuccccagacgacucgcccga

SEQ ID NO: 3130 - RNA, 51 nt, Artificial Sequence
  Description of Artificial Sequence: Synthetic oligonucleotide
gggaggacgaugcggucucugggauuuccugcccccagacgacucgcccga

SEQ ID NO: 3131 - RNA, 51 nt, Artificial Sequence
  Description of Artificial Sequence: Synthetic oligonucleotide
gggaggacgaugcggucuugucgucuguucguccucagacgacucgcccga

SEQ ID NO: 3132 - RNA, 51 nt, Artificial Sequence
  Description of Artificial Sequence: Synthetic oligonucleotide
gggaggacgaugcggucuugucguuuguucguccccagacgacucgcccga

SEQ ID NO: 3133 - RNA, 51 nt, Artificial Sequence
  Description of Artificial Sequence: Synthetic oligonucleotide
gggaggacgaugcggugagccguucccuucguccccagacgacucgcccga

SEQ ID NO: 3134 - RNA, 51 nt, Artificial Sequence
  Description of Artificial Sequence: Synthetic oligonucleotide
gggaggacgaugcggugagucguuccuuucguccccagacgacucgcccga

SEQ ID NO: 3135 - RNA, 51 nt, Artificial Sequence
  Description of Artificial Sequence: Synthetic oligonucleotide
gggaggacgaugcggugauguccgcucagucgcuacagacgacucgcccga

SEQ ID NO: 3136 - RNA, 51 nt, Artificial Sequence
  Description of Artificial Sequence: Synthetic oligonucleotide
gggaggacgaugcggugccugucguuugaugccgccagacgacucgcccga

SEQ ID NO: 3137 - RNA, 51 nt, Artificial Sequence
  Description of Artificial Sequence: Synthetic oligonucleotide
gggaggacgaugcggugccuguugucuguggccgccagacgacucgcccga

SEQ ID NO: 3138 - RNA, 51 nt, Artificial Sequence
  Description of Artificial Sequence: Synthetic oligonucleotide
gggaggacgaugcggugcguugucugugcccuccccagacgacucgcccga

SEQ ID NO: 3139 - RNA, 51 nt, Artificial Sequence
  Description of Artificial Sequence: Synthetic oligonucleotide
gggaggacgaugcgguguugucgucuguucguccccagacgacucgcccga

SEQ ID NO: 3140 - RNA, 51 nt, Artificial Sequence
  Description of Artificial Sequence: Synthetic oligonucleotide
gggaggacgaugcgguuagucguuuguugggccgccagacgacucgcccga

SEQ ID NO: 3141 - RNA, 49 nt, Artificial Sequence
  Description of Artificial Sequence: Synthetic oligonucleotide
gggaggacgaugcgguccugucgucuuuguccccagacgacucgcccga

SEQ ID NO: 3142 - RNA, 51 nt, Artificial Sequence
  Description of Artificial Sequence: Synthetic oligonucleotide
gggaggacgaugcgguccuguugucuguuuguccccagacgacucgcccga

SEQ ID NO: 3143 - RNA, 51 nt, Artificial Sequence
  Description of Artificial Sequence: Synthetic oligonucleotide
gggaggacgaugcgguuugggguuuucccgugccacagacgacucgcccga

SEQ ID NO: 3144 - RNA, 52 nt, Artificial Sequence
  Description of Artificial Sequence: Synthetic oligonucleotide
gggaggacgaugcgguuugggguuuucccgugcccccagacgacucgcccga

SEQ ID NO: 3145 - RNA, 51 nt, Artificial Sequence
  Description of Artificial Sequence: Synthetic oligonucleotide
gggaggacgaugcgguuugggguuuuucccgugcccagacgacucgcccga

SEQ ID NO: 3146 - RNA, 52 nt, Artificial Sequence
  Description of Artificial Sequence: Synthetic oligonucleotide
gggaggacgaugcgguuugggguuuuucccgucccccagacgacucgcccga

SEQ ID NO: 3147 - RNA, 51 nt, Artificial Sequence
  Description of Artificial Sequence: Synthetic oligonucleotide
gggaggacgaugcggaccugucgucuguucgucaccagacgacucgcccga

SEQ ID NO: 3148 - RNA, 51 nt, Artificial Sequence
  Description of Artificial Sequence: Synthetic oligonucleotide
gggaggacgaugcggacuugucgucuguucguccccagacgacucgcccga

SEQ ID NO: 3149 - RNA, 52 nt, Artificial Sequence
  Description of Artificial Sequence: Synthetic oligonucleotide
gggaggacgaugcggauugggguuuuucccgugccccagacgacucgcccga

SEQ ID NO: 3150 - RNA, 51 nt, Artificial Sequence
  Description of Artificial Sequence: Synthetic oligonucleotide
gggaggacgaugcggccagucguucugcgccuccccagacgacucgcccga

SEQ ID NO: 3151 - RNA, 51 nt, Artificial Sequence
  Description of Artificial Sequence: Synthetic oligonucleotide
gggaggacgaugcggcccugucgucuguucgucaccagacgacucgcccga

SEQ ID NO: 3152 - RNA, 51 nt, Artificial Sequence
  Description of Artificial Sequence: Synthetic oligonucleotide
gggaggacgaugcggcccugucgucuguucgugcccagacgacucgcccga

SEQ ID NO: 3153 - RNA, 51 nt, Artificial Sequence
  Description of Artificial Sequence: Synthetic oligonucleotide
gggaggacgaugcggccgaguccucugaucguccccagacgacucgcccga

SEQ ID NO: 3154 - RNA, 51 nt, Artificial Sequence
  Description of Artificial Sequence: Synthetic oligonucleotide
gggaggacgaugcggccugucgucuguagccuccccagacgacucgcccga

SEQ ID NO: 3155 - RNA, 51 nt, Artificial Sequence
  Description of Artificial Sequence: Synthetic oligonucleotide
gggaggacgaugcggccuucgucuguuccccuccccagacgacucgcccga

SEQ ID NO: 3156 - RNA, 51 nt, Artificial Sequence
  Description of Artificial Sequence: Synthetic oligonucleotide
gggaggacgaugcggcgaaucguucugcaacuccccagacgacucgcccga

SEQ ID NO: 3157 - RNA, 51 nt, Artificial Sequence
  Description of Artificial Sequence: Synthetic oligonucleotide
gggaggacgaugcggcgacuccucuguuuccuccccagacgacucgcccga

SEQ ID NO: 3158 - RNA, 51 nt, Artificial Sequence
  Description of Artificial Sequence: Synthetic oligonucleotide
gggaggacgaugcggcgacucucugcuucucuccccagacgacucgcccga

SEQ ID NO: 3159 - RNA, 51 nt, Artificial Sequence
  Description of Artificial Sequence: Synthetic oligonucleotide
gggaggacgaugcggcgauucgucucucucguccccagacgacucgcccga

SEQ ID NO: 3160 - RNA, 51 nt, Artificial Sequence
  Description of Artificial Sequence: Synthetic oligonucleotide
gggaggacgaugcggcgccucgucuguaugcuccccagacgacucgcccga

SEQ ID NO: 3161 - RNA, 51 nt, Artificial Sequence
  Description of Artificial Sequence: Synthetic oligonucleotide
gggaggacgaugcggcguucccucugguucguccccagacgacucgcccga

SEQ ID NO: 3162 - RNA, 51 nt, Artificial Sequence
  Description of Artificial Sequence: Synthetic oligonucleotide
gggaggacgaugcggcguucguucugguucguccccagacgacucgcccga

SEQ ID NO: 3163 - RNA, 51 nt, Artificial Sequence
  Description of Artificial Sequence: Synthetic oligonucleotide
gggaggacgaugcggcguuuccccugguucguccccagacgacucgcccga

SEQ ID NO: 3164 - RNA, 50 nt, Artificial Sequence
  Description of Artificial Sequence: Synthetic oligonucleotide
gggaggacgaugcggcguuuccucuguucguccccagacgacucgcccga

SEQ ID NO: 3165 - RNA, 51 nt, Artificial Sequence
  Description of Artificial Sequence: Synthetic oligonucleotide
gggaggacgaugcggcguuuccuuugguucguccccagacgacucgcccga

SEQ ID NO: 3166 - RNA, 51 nt, Artificial Sequence
  Description of Artificial Sequence: Synthetic oligonucleotide
gggaggacgaugcgggaguuuccucuguucguccccagacgacucgcccga

SEQ ID NO: 3167 - RNA, 51 nt, Artificial Sequence
  Description of Artificial Sequence: Synthetic oligonucleotide
gggaggacgaugcgggccaucucgucuuacguccccagacgacucgcccga

SEQ ID NO: 3168 - RNA, 51 nt, Artificial Sequence
  Description of Artificial Sequence: Synthetic oligonucleotide
gggaggacgaugcgggcccucguuugcugucaccccagacgacucgcccga

SEQ ID NO: 3169 - RNA, 51 nt, Artificial Sequence
  Description of Artificial Sequence: Synthetic oligonucleotide
gggaggacgaugcgggcccuucgucuaagccuccccagacgacucgcccga

SEQ ID NO: 3170 - RNA, 51 nt, Artificial Sequence
  Description of Artificial Sequence: Synthetic oligonucleotide
gggaggacgaugcgggccguuucgucuauccuccccagacgacucgcccga

SEQ ID NO: 3171 - RNA, 51 nt, Artificial Sequence
  Description of Artificial Sequence: Synthetic oligonucleotide
gggaggacgaugcgggccucucgucuguuccuccccagacgacucgcccga

SEQ ID NO: 3172 - RNA, 51 nt, Artificial Sequence
  Description of Artificial Sequence: Synthetic oligonucleotide
gggaggacgaugcgggccucucgucuuaagucccccagacgacucgcccga

SEQ ID NO: 3173 - RNA, 51 nt, Artificial Sequence
  Description of Artificial Sequence: Synthetic oligonucleotide
gggaggacgaugcgggcgcauucgucguacguccccagacgacucgcccga

SEQ ID NO: 3174 - RNA, 51 nt, Artificial Sequence
  Description of Artificial Sequence: Synthetic oligonucleotide
gggaggacgaugcgggcgucucucugcugucuccccagacgacucgcccga

SEQ ID NO: 3175 - RNA, 51 nt, Artificial Sequence
  Description of Artificial Sequence: Synthetic oligonucleotide
gggaggacgaugcggggaucgucugauuaccuccccagacgacucgcccga

SEQ ID NO: 3176 - RNA, 49 nt, Artificial Sequence
  Description of Artificial Sequence: Synthetic oligonucleotide
gggaggacgaugcggguccugucgucucguccccagacgacucgcccga

SEQ ID NO: 3177 - RNA, 51 nt, Artificial Sequence
  Description of Artificial Sequence: Synthetic oligonucleotide
gggaggacgaugcggguccugucgucuguucguuccagacgacucgcccga

SEQ ID NO: 3178 - RNA, 52 nt, Artificial Sequence
  Description of Artificial Sequence: Synthetic oligonucleotide
gggaggacgaugcggguccugucgucuguugguccccagacgacucgcccga

SEQ ID NO: 3179 - RNA, 51 nt, Artificial Sequence
  Description of Artificial Sequence: Synthetic oligonucleotide
gggaggacgaugcgggugauuccucugcccuuccccagacgacucgcccga

SEQ ID NO: 3180 - RNA, 51 nt, Artificial Sequence
  Description of Artificial Sequence: Synthetic oligonucleotide
gggaggacgaugcgguacugucgucuguuaguacccagacgacucgcccga

SEQ ID NO: 3181 - RNA, 51 nt, Artificial Sequence
  Description of Artificial Sequence: Synthetic oligonucleotide
gggaggacgaugcggucaugucgucuguucgucuccagacgacucgcccga

SEQ ID NO: 3182 - RNA, 51 nt, Artificial Sequence
  Description of Artificial Sequence: Synthetic oligonucleotide
gggaggacgaugcgguccaggcuugucguuguccccagacgacucgcccga

SEQ ID NO: 3183 - RNA, 50 nt, Artificial Sequence
  Description of Artificial Sequence: Synthetic oligonucleotide
gggaggacgaugcgguccagucguuuguugccgccagacgacucgcccga

SEQ ID NO: 3184 - RNA, 51 nt, Artificial Sequence
  Description of Artificial Sequence: Synthetic oligonucleotide
gggaggacgaugcggucccgucguccguucguccccagacgacucgcccga

SEQ ID NO: 3185 - RNA, 51 nt, Artificial Sequence
  Description of Artificial Sequence: Synthetic oligonucleotide
gggaggacgaugcggucccgucgucuguuccuccccagacgacucgcccga

SEQ ID NO: 3186 - RNA, 50 nt, Artificial Sequence
  Description of Artificial Sequence: Synthetic oligonucleotide
gggaggacgaugcggucccgucgucuguucgucccagacgacucgcccga

SEQ ID NO: 3187 - RNA, 50 nt, Artificial Sequence
  Description of Artificial Sequence: Synthetic oligonucleotide
gggaggacgaugcgguccggcuugucguuguccccagacgacucgcccga

SEQ ID NO: 3188 - RNA, 51 nt, Artificial Sequence
  Description of Artificial Sequence: Synthetic oligonucleotide
gggaggacgaugcgguccuaucguccguucguccccagacgacucgcccga

SEQ ID NO: 3189 - RNA, 51 nt, Artificial Sequence
  Description of Artificial Sequence: Synthetic oligonucleotide
gggaggacgaugcgguccugccgccuguucguccccagacgacucgcccga

SEQ ID NO: 3190 - RNA, 51 nt, Artificial Sequence
  Description of Artificial Sequence: Synthetic oligonucleotide
gggaggacgaugcgguccugccguccguucguccccagacgacucgcccga

SEQ ID NO: 3191 - RNA, 51 nt, Artificial Sequence
  Description of Artificial Sequence: Synthetic oligonucleotide
gggaggacgaugcgguccuggcaugucguuguccccagacgacucgcccga

SEQ ID NO: 3192 - RNA, 48 nt, Artificial Sequence
  Description of Artificial Sequence: Synthetic oligonucleotide
gggaggacgaugcgguccuggcuugucguccccagacgacucgcccga

SEQ ID NO: 3193 - RNA, 51 nt, Artificial Sequence
  Description of Artificial Sequence: Synthetic oligonucleotide
gggaggacgaugcgguccuggcuugucguugguuccagacgacucgcccga

SEQ ID NO: 3194 - RNA, 51 nt, Artificial Sequence
  Description of Artificial Sequence: Synthetic oligonucleotide
gggaggacgaugcgguccuggcuugugguuguccccagacgacucgcccga

SEQ ID NO: 3195 - RNA, 51 nt, Artificial Sequence
  Description of Artificial Sequence: Synthetic oligonucleotide
gggaggacgaugcgguccugucgccuguucguuuccagacgacucgcccga

SEQ ID NO: 3196 - RNA, 51 nt, Artificial Sequence
  Description of Artificial Sequence: Synthetic oligonucleotide
gggaggacgaugcgguccugucguauguuaguacccagacgacucgcccga

SEQ ID NO: 3197 - RNA, 51 nt, Artificial Sequence
  Description of Artificial Sequence: Synthetic oligonucleotide
gggaggacgaugcgguccugucguauguuagucaccagacgacucgcccga

SEQ ID NO: 3198 - RNA, 51 nt, Artificial Sequence
  Description of Artificial Sequence: Synthetic oligonucleotide
gggaggacgaugcgguccugucguauguuaguccacagacgacucgcccga

SEQ ID NO: 3199 - RNA, 51 nt, Artificial Sequence
  Description of Artificial Sequence: Synthetic oligonucleotide
gggaggacgaugcgguccugucguccguccguccccagacgacucgcccga

SEQ ID NO: 3200 - RNA, 51 nt, Artificial Sequence
  Description of Artificial Sequence: Synthetic oligonucleotide
gggaggacgaugcgguccugucgucugaucguucccagacgacucgcccga

SEQ ID NO: 3201 - RNA, 51 nt, Artificial Sequence
  Description of Artificial Sequence: Synthetic oligonucleotide
gggaggacgaugcgguccugucgucuguauguccccagacgacucgcccga

SEQ ID NO: 3202 - RNA, 50 nt, Artificial Sequence
  Description of Artificial Sequence: Synthetic oligonucleotide
gggaggacgaugcgguccugucgucugucguucccagacgacucgcccga

SEQ ID NO: 3203 - RNA, 51 nt, Artificial Sequence
  Description of Artificial Sequence: Synthetic oligonucleotide
gggaggacgaugcgguccugucgucuguuccuuuccagacgacucgcccga

SEQ ID NO: 3204 - RNA, 51 nt, Artificial Sequence
  Description of Artificial Sequence: Synthetic oligonucleotide
gggaggacgaugcgguccugucgucuguucgaacccagacgacucgcccga

SEQ ID NO: 3205 - RNA, 50 nt, Artificial Sequence
  Description of Artificial Sequence: Synthetic oligonucleotide
gggaggacgaugcgguccugucgucuguucgucgcagacgacucgcccga

SEQ ID NO: 3206 - RNA, 50 nt, Artificial Sequence
  Description of Artificial Sequence: Synthetic oligonucleotide
gggaggacgaugcgguccugucgucuguuguuuccagacgacucgcccga

SEQ ID NO: 3207 - RNA, 51 nt, Artificial Sequence
  Description of Artificial Sequence: Synthetic oligonucleotide
gggaggacgaugcgguccugucgucuguuuguccucagacgacucgcccga

SEQ ID NO: 3208 - RNA, 51 nt, Artificial Sequence
  Description of Artificial Sequence: Synthetic oligonucleotide
gggaggacgaugcgguccugucgucuguuugucuccagacgacucgcccga

SEQ ID NO: 3209 - RNA, 51 nt, Artificial Sequence
  Description of Artificial Sequence: Synthetic oligonucleotide
gggaggacgaugcgguccugucgucuuuucguacccagacgacucgcccga

SEQ ID NO: 3210 - RNA, 51 nt, Artificial Sequence
  Description of Artificial Sequence: Synthetic oligonucleotide
gggaggacgaugcgguccugucuucuuuucguccccagacgacucgcccga

SEQ ID NO: 3211 - RNA, 51 nt, Artificial Sequence
  Description of Artificial Sequence: Synthetic oligonucleotide
gggaggacgaugcgguccugucuugucguuguccccagacgacucgcccga

SEQ ID NO: 3212 - RNA, 51 nt, Artificial Sequence
  Description of Artificial Sequence: Synthetic oligonucleotide
gggaggacgaugcgguccuguugucuguucguacccagacgacucgcccga

SEQ ID NO: 3213 - RNA, 51 nt, Artificial Sequence
  Description of Artificial Sequence: Synthetic oligonucleotide
gggaggacgaugcgguccuguuguuuguucguccccagacgacucgcccga

SEQ ID NO: 3214 - RNA, 51 nt, Artificial Sequence
  Description of Artificial Sequence: Synthetic oligonucleotide
gggaggacgaugcggucgugucguuuguucguccccagacgacucgcccga

SEQ ID NO: 3215 - RNA, 51 nt, Artificial Sequence
  Description of Artificial Sequence: Synthetic oligonucleotide
gggaggacgaugcggucguguugucuguucguccccagacgacucgcccga

SEQ ID NO: 3216 - RNA, 51 nt, Artificial Sequence
  Description of Artificial Sequence: Synthetic oligonucleotide
gggaggacgaugcggucucuggguuuuugccgccccagacgacucgcccga

SEQ ID NO: 3217 - RNA, 50 nt, Artificial Sequence
  Description of Artificial Sequence: Synthetic oligonucleotide
gggaggacgaugcggucuggcuugucguuguccccagacgacucgcccga

SEQ ID NO: 3218 - RNA, 50 nt, Artificial Sequence
  Description of Artificial Sequence: Synthetic oligonucleotide
gggaggacgaugcggucuugucgucugucguccccagacgacucgcccga

SEQ ID NO: 3219 - RNA, 50 nt, Artificial Sequence
  Description of Artificial Sequence: Synthetic oligonucleotide
gggaggacgaugcggugacucgucuguucguccccagacgacucgcccga

SEQ ID NO: 3220 - RNA, 51 nt, Artificial Sequence
  Description of Artificial Sequence: Synthetic oligonucleotide
gggaggacgaugcggugagucgcucccuucguccccagacgacucgcccga

SEQ ID NO: 3221 - RNA, 51 nt, Artificial Sequence
  Description of Artificial Sequence: Synthetic oligonucleotide
gggaggacgaugcgguugacucgucugcgccuccccagacgacucgcccga

SEQ ID NO: 3222 - RNA, 51 nt, Artificial Sequence
  Description of Artificial Sequence: Synthetic oligonucleotide
gggaggacgaugcgguuugggguuuucccuugccccagacgacucgcccga

SEQ ID NO: 3223 - RNA, 52 nt, Artificial Sequence
  Description of Artificial Sequence: Synthetic oligonucleotide
gggaggacgaugcgguuugggguuuucuucccgccccagacgacucgcccga

SEQ ID NO: 3224 - RNA, 53 nt, Artificial Sequence
  Description of Artificial Sequence: Synthetic oligonucleotide
gggaggacgaugcgguuuugggguuuuucccgugccccagacgacucgcccga

SEQ ID NO: 3225 - RNA, 52 nt, Artificial Sequence
  Description of Artificial Sequence: Synthetic oligonucleotide
gggaggacgaugcggcuugggguuuuucccgugccccagacgacucgcccga

SEQ ID NO: 3226 - RNA, 51 nt, Artificial Sequence
  Description of Artificial Sequence: Synthetic oligonucleotide
gggaggacgaugcggucagcacauuucccggugugcagacgacucgcccga

SEQ ID NO: 3227 - RNA, 51 nt, Artificial Sequence
  Description of Artificial Sequence: Synthetic oligonucleotide
gggaggacgaugcgguuugggguuuuucccugccccagacgacucgcccga

SEQ ID NO: 3228 - RNA, 51 nt, Artificial Sequence
  Description of Artificial Sequence: Synthetic oligonucleotide
gggaggacgaugcggagcgacucuucuggccuccccagacgacucgcccga

SEQ ID NO: 3229 - RNA, 51 nt, Artificial Sequence
  Description of Artificial Sequence: Synthetic oligonucleotide
gggaggacgaugcggcacaguucgucugcacuccccagacgacucgcccga

SEQ ID NO: 3230 - RNA, 51 nt, Artificial Sequence
  Description of Artificial Sequence: Synthetic oligonucleotide
gggaggacgaugcggcccugucgucugcucuuccccagacgacucgcccga

SEQ ID NO: 3231 - RNA, 51 nt, Artificial Sequence
  Description of Artificial Sequence: Synthetic oligonucleotide
gggaggacgaugcggcccugucuucuguucguccccagacgacucgcccga

SEQ ID NO: 3232 - RNA, 51 nt, Artificial Sequence
  Description of Artificial Sequence: Synthetic oligonucleotide
gggaggacgaugcggcccuucgucugauucucccccagacgacucgcccga

SEQ ID NO: 3233 - RNA, 51 nt, Artificial Sequence
  Description of Artificial Sequence: Synthetic oligonucleotide
gggaggacgaugcggcccuuucgucugaaccuccccagacgacucgcccga

SEQ ID NO: 3234 - RNA, 51 nt, Artificial Sequence
  Description of Artificial Sequence: Synthetic oligonucleotide
gggaggacgaugcggccugucgucuauucccuccccagacgacucgcccga

SEQ ID NO: 3235 - RNA, 50 nt, Artificial Sequence
  Description of Artificial Sequence: Synthetic oligonucleotide
gggaggacgaugcggccugucgucugcucguccccagacgacucgcccga

SEQ ID NO: 3236 - RNA, 50 nt, Artificial Sequence
  Description of Artificial Sequence: Synthetic oligonucleotide
gggaggacgaugcggccugucgucuguucguucccagacgacucgcccga

SEQ ID NO: 3237 - RNA, 50 nt, Artificial Sequence
  Description of Artificial Sequence: Synthetic oligonucleotide
gggaggacgaugcggccugucgucuguucguuuccagacgacucgcccga

SEQ ID NO: 3238 - RNA, 51 nt, Artificial Sequence
  Description of Artificial Sequence: Synthetic oligonucleotide
gggaggacgaugcggccugucguucugcuccuccccagacgacucgcccga

SEQ ID NO: 3239 - RNA, 51 nt, Artificial Sequence
  Description of Artificial Sequence: Synthetic oligonucleotide
gggaggacgaugcggccuuucgucuggcucguccccagacgacucgcccga

SEQ ID NO: 3240 - RNA, 51 nt, Artificial Sequence
  Description of Artificial Sequence: Synthetic oligonucleotide
gggaggacgaugcggcgacgucugucuauccuccccagacgacucgcccga

SEQ ID NO: 3241 - RNA, 51 nt, Artificial Sequence
  Description of Artificial Sequence: Synthetic oligonucleotide
gggaggacgaugcggcgacgucuguuaccacuccccagacgacucgcccga

SEQ ID NO: 3242 - RNA, 51 nt, Artificial Sequence
  Description of Artificial Sequence: Synthetic oligonucleotide
gggaggacgaugcggcgacucuucugcacccuccccagacgacucgcccga

SEQ ID NO: 3243 - RNA, 51 nt, Artificial Sequence
  Description of Artificial Sequence: Synthetic oligonucleotide
gggaggacgaugcggcgacuucguucugucucccccagacgacucgcccga

SEQ ID NO: 3244 - RNA, 51 nt, Artificial Sequence
  Description of Artificial Sequence: Synthetic oligonucleotide
gggaggacgaugcggcgaguucucuguguucuccccagacgacucgcccga

SEQ ID NO: 3245 - RNA, 51 nt, Artificial Sequence
  Description of Artificial Sequence: Synthetic oligonucleotide
gggaggacgaugcggcgaugucucugcuuccuccccagacgacucgcccga

SEQ ID NO: 3246 - RNA, 51 nt, Artificial Sequence
  Description of Artificial Sequence: Synthetic oligonucleotide
gggaggacgaugcggcgauucgaucuuuccguccccagacgacucgcccga

SEQ ID NO: 3247 - RNA, 51 nt, Artificial Sequence
  Description of Artificial Sequence: Synthetic oligonucleotide
gggaggacgaugcggcgucucgaucugccacuccccagacgacucgcccga

SEQ ID NO: 3248 - RNA, 51 nt, Artificial Sequence
  Description of Artificial Sequence: Synthetic oligonucleotide
gggaggacgaugcggcgucucgucugacucguccccagacgacucgcccga

SEQ ID NO: 3249 - RNA, 51 nt, Artificial Sequence
  Description of Artificial Sequence: Synthetic oligonucleotide
gggaggacgaugcggcguuucgucuuuuucguccccagacgacucgcccga

SEQ ID NO: 3250 - RNA, 51 nt, Artificial Sequence
  Description of Artificial Sequence: Synthetic oligonucleotide
gggaggacgaugcggcugaagucuucugcgcuccccagacgacucgcccga

SEQ ID NO: 3251 - RNA, 51 nt, Artificial Sequence
  Description of Artificial Sequence: Synthetic oligonucleotide
gggaggacgaugcgggauagucuucugucccuccccagacgacucgcccga

SEQ ID NO: 3252 - RNA, 51 nt, Artificial Sequence
  Description of Artificial Sequence: Synthetic oligonucleotide
gggaggacgaugcgggcaaaucguuugcaccuccccagacgacucgcccga

SEQ ID NO: 3253 - RNA, 51 nt, Artificial Sequence
  Description of Artificial Sequence: Synthetic oligonucleotide
gggaggacgaugcgggcaauucguucuggccuccccagacgacucgcccga

SEQ ID NO: 3254 - RNA, 51 nt, Artificial Sequence
  Description of Artificial Sequence: Synthetic oligonucleotide
gggaggacgaugcgggcagucuucugucgcguccccagacgacucgcccga

SEQ ID NO: 3255 - RNA, 51 nt, Artificial Sequence
  Description of Artificial Sequence: Synthetic oligonucleotide
gggaggacgaugcgggccauguugucugaccuccccagacgacucgcccga

SEQ ID NO: 3256 - RNA, 51 nt, Artificial Sequence
  Description of Artificial Sequence: Synthetic oligonucleotide
gggaggacgaugcgggcccguugucuguucguccccagacgacucgcccga

SEQ ID NO: 3257 - RNA, 51 nt, Artificial Sequence
  Description of Artificial Sequence: Synthetic oligonucleotide
gggaggacgaugcgggcccuucugucugucucccccagacgacucgcccga

SEQ ID NO: 3258 - RNA, 51 nt, Artificial Sequence
  Description of Artificial Sequence: Synthetic oligonucleotide
gggaggacgaugcgggccucucgucugacucuccccagacgacucgcccga

SEQ ID NO: 3259 - RNA, 51 nt, Artificial Sequence
  Description of Artificial Sequence: Synthetic oligonucleotide
gggaggacgaugcgggccuuccgucugcuacuccccagacgacucgcccga

SEQ ID NO: 3260 - RNA, 51 nt, Artificial Sequence
  Description of Artificial Sequence: Synthetic oligonucleotide
gggaggacgaugcgggccuucguuugcacacuccccagacgacucgcccga

SEQ ID NO: 3261 - RNA, 51 nt, Artificial Sequence
  Description of Artificial Sequence: Synthetic oligonucleotide
gggaggacgaugcgggccuuucgcucugaccuccccagacgacucgcccga

SEQ ID NO: 3262 - RNA, 51 nt, Artificial Sequence
  Description of Artificial Sequence: Synthetic oligonucleotide
gggaggacgaugcgggccuuucguucuaaccuccccagacgacucgcccga

SEQ ID NO: 3263 - RNA, 51 nt, Artificial Sequence
  Description of Artificial Sequence: Synthetic oligonucleotide
gggaggacgaugcgggccuuucguuugugccuccccagacgacucgcccga

SEQ ID NO: 3264 - RNA, 51 nt, Artificial Sequence
  Description of Artificial Sequence: Synthetic oligonucleotide
gggaggacgaugcgggcgauccucugucuccuccccagacgacucgcccga

SEQ ID NO: 3265 - RNA, 52 nt, Artificial Sequence
  Description of Artificial Sequence: Synthetic oligonucleotide
gggaggacgaugcgggcguuuuccucuguucguccccagacgacucgcccga

SEQ ID NO: 3266 - RNA, 51 nt, Artificial Sequence
  Description of Artificial Sequence: Synthetic oligonucleotide
gggaggacgaugcgggcugucuucugucuccuccccagacgacucgcccga

SEQ ID NO: 3267 - RNA, 51 nt, Artificial Sequence
  Description of Artificial Sequence: Synthetic oligonucleotide
gggaggacgaugcgggcuguuguugucugccuccccagacgacucgcccga

SEQ ID NO: 3268 - RNA, 51 nt, Artificial Sequence
  Description of Artificial Sequence: Synthetic oligonucleotide
gggaggacgaugcgggcuugcuucugguucguccccagacgacucgcccga

SEQ ID NO: 3269 - RNA, 51 nt, Artificial Sequence
  Description of Artificial Sequence: Synthetic oligonucleotide
gggaggacgaugcgggcuugucuucugcucguccccagacgacucgcccga

SEQ ID NO: 3270 - RNA, 51 nt, Artificial Sequence
  Description of Artificial Sequence: Synthetic oligonucleotide
gggaggacgaugcgggcuugucuucuguccguccccagacgacucgcccga

SEQ ID NO: 3271 - RNA, 51 nt, Artificial Sequence
  Description of Artificial Sequence: Synthetic oligonucleotide
gggaggacgaugcggggaguccucuguauccuccccagacgacucgcccga

SEQ ID NO: 3272 - RNA, 52 nt, Artificial Sequence
  Description of Artificial Sequence: Synthetic oligonucleotide
gggaggacgaugcggguccugucguauguucguccccagacgacucgcccga

SEQ ID NO: 3273 - RNA, 49 nt, Artificial Sequence
  Description of Artificial Sequence: Synthetic oligonucleotide
gggaggacgaugcggguccugucgucuguuccccagacgacucgcccga

SEQ ID NO: 3274 - RNA, 52 nt, Artificial Sequence
  Description of Artificial Sequence: Synthetic oligonucleotide
gggaggacgaugcggguccugucgucuguucguccgcagacgacucgcccga

SEQ ID NO: 3275 - RNA, 52 nt, Artificial Sequence
  Description of Artificial Sequence: Synthetic oligonucleotide
gggaggacgaugcggguccugucguguguucguccccagacgacucgcccga

SEQ ID NO: 3276 - RNA, 51 nt, Artificial Sequence
  Description of Artificial Sequence: Synthetic oligonucleotide
gggaggacgaugcgggucgauucguuugaugccgccagacgacucgcccga

SEQ ID NO: 3277 - RNA, 51 nt, Artificial Sequence
  Description of Artificial Sequence: Synthetic oligonucleotide
gggaggacgaugcgggucugucgucuguucguccccagacgacucgcccga

SEQ ID NO: 3278 - RNA, 51 nt, Artificial Sequence
  Description of Artificial Sequence: Synthetic oligonucleotide
gggaggacgaugcgguaauguaguauguuagucaccagacgacucgcccga

SEQ ID NO: 3279 - RNA, 52 nt, Artificial Sequence
  Description of Artificial Sequence: Synthetic oligonucleotide
gggaggacgaugcgguaccugucgucuguucguccccagacgacucgcccga

SEQ ID NO: 3280 - RNA, 51 nt, Artificial Sequence
  Description of Artificial Sequence: Synthetic oligonucleotide
gggaggacgaugcggucauguagucuguucguccacagacgacucgcccga

SEQ ID NO: 3281 - RNA, 51 nt, Artificial Sequence
  Description of Artificial Sequence: Synthetic oligonucleotide
gggaggacgaugcggucaugucguauguucguacccagacgacucgcccga

SEQ ID NO: 3282 - RNA, 51 nt, Artificial Sequence
  Description of Artificial Sequence: Synthetic oligonucleotide
gggaggacgaugcggucaugucgucuguuuguccccagacgacucgcccga

SEQ ID NO: 3283 - RNA, 51 nt, Artificial Sequence
  Description of Artificial Sequence: Synthetic oligonucleotide
gggaggacgaugcgguccagucgucuguucguacccagacgacucgcccga

SEQ ID NO: 3284 - RNA, 51 nt, Artificial Sequence
  Description of Artificial Sequence: Synthetic oligonucleotide
gggaggacgaugcgguccaguugucugcugcuccccagacgacucgcccga

SEQ ID NO: 3285 - RNA, 51 nt, Artificial Sequence
  Description of Artificial Sequence: Synthetic oligonucleotide
gggaggacgaugcggucccgucgucuguuuguccccagacgacucgcccga

SEQ ID NO: 3286 - RNA, 51 nt, Artificial Sequence
  Description of Artificial Sequence: Synthetic oligonucleotide
gggaggacgaugcgguccuaucgucugcucguccccagacgacucgcccga

SEQ ID NO: 3287 - RNA, 51 nt, Artificial Sequence
  Description of Artificial Sequence: Synthetic oligonucleotide
gggaggacgaugcgguccuggauugucguuguccccagacgacucgcccga

SEQ ID NO: 3288 - RNA, 51 nt, Artificial Sequence
  Description of Artificial Sequence: Synthetic oligonucleotide
gggaggacgaugcgguccuggcuuaucguuguccccagacgacucgcccga

SEQ ID NO: 3289 - RNA, 51 nt, Artificial Sequence
  Description of Artificial Sequence: Synthetic oligonucleotide
gggaggacgaugcgguccuggcuugacguuguccccagacgacucgcccga

SEQ ID NO: 3290 - RNA, 51 nt, Artificial Sequence
  Description of Artificial Sequence: Synthetic oligonucleotide
gggaggacgaugcgguccuggcuuguaguuguccccagacgacucgcccga

SEQ ID NO: 3291 - RNA, 51 nt, Artificial Sequence
  Description of Artificial Sequence: Synthetic oligonucleotide
gggaggacgaugcgguccuggcuugucguuggccccagacgacucgcccga

SEQ ID NO: 3292 - RNA, 51 nt, Artificial Sequence
  Description of Artificial Sequence: Synthetic oligonucleotide
gggaggacgaugcgguccuggcuugucguugucaccagacgacucgcccga

SEQ ID NO: 3293 - RNA, 51 nt, Artificial Sequence
  Description of Artificial Sequence: Synthetic oligonucleotide
gggaggacgaugcgguccuguagucuguuaguacccagacgacucgcccga

SEQ ID NO: 3294 - RNA, 51 nt, Artificial Sequence
  Description of Artificial Sequence: Synthetic oligonucleotide
gggaggacgaugcgguccuguagucuguuaguccacagacgacucgcccga

SEQ ID NO: 3295 - RNA, 51 nt, Artificial Sequence
  Description of Artificial Sequence: Synthetic oligonucleotide
gggaggacgaugcgguccuguagucuguucgucuccagacgacucgcccga

SEQ ID NO: 3296 - RNA, 51 nt, Artificial Sequence
  Description of Artificial Sequence: Synthetic oligonucleotide
gggaggacgaugcgguccugucaucuguucauccccagacgacucgcccga

SEQ ID NO: 3297 - RNA, 50 nt, Artificial Sequence
  Description of Artificial Sequence: Synthetic oligonucleotide
gggaggacgaugcgguccugucgccguucguccccagacgacucgcccga

SEQ ID NO: 3298 - RNA, 51 nt, Artificial Sequence
  Description of Artificial Sequence: Synthetic oligonucleotide
gggaggacgaugcgguccugucgccuguuccuccccagacgacucgcccga

SEQ ID NO: 3299 - RNA, 51 nt, Artificial Sequence
  Description of Artificial Sequence: Synthetic oligonucleotide
gggaggacgaugcgguccugucgccuguucguucccagacgacucgcccga

SEQ ID NO: 3300 - RNA, 51 nt, Artificial Sequence
  Description of Artificial Sequence: Synthetic oligonucleotide
gggaggacgaugcgguccugucguauguucgucuccagacgacucgcccga

SEQ ID NO: 3301 - RNA, 51 nt, Artificial Sequence
  Description of Artificial Sequence: Synthetic oligonucleotide
gggaggacgaugcgguccugucgucuauucguucccagacgacucgcccga

SEQ ID NO: 3302 - RNA, 51 nt, Artificial Sequence
  Description of Artificial Sequence: Synthetic oligonucleotide
gggaggacgaugcgguccugucgucucuucguucccagacgacucgcccga

SEQ ID NO: 3303 - RNA, 51 nt, Artificial Sequence
  Description of Artificial Sequence: Synthetic oligonucleotide
gggaggacgaugcgguccugucgucugaucauccccagacgacucgcccga

SEQ ID NO: 3304 - RNA, 51 nt, Artificial Sequence
  Description of Artificial Sequence: Synthetic oligonucleotide
gggaggacgaugcgguccugucgucuguacguucccagacgacucgcccga

SEQ ID NO: 3305 - RNA, 51 nt, Artificial Sequence
  Description of Artificial Sequence: Synthetic oligonucleotide
gggaggacgaugcgguccugucgucuguccguucccagacgacucgcccga

SEQ ID NO: 3306 - RNA, 51 nt, Artificial Sequence
  Description of Artificial Sequence: Synthetic oligonucleotide
gggaggacgaugcgguccugucgucuguccguuuccagacgacucgcccga

SEQ ID NO: 3307 - RNA, 50 nt, Artificial Sequence
  Description of Artificial Sequence: Synthetic oligonucleotide
gggaggacgaugcgguccugucgucuguucaucccagacgacucgcccga

SEQ ID NO: 3308 - RNA, 51 nt, Artificial Sequence
  Description of Artificial Sequence: Synthetic oligonucleotide
gggaggacgaugcgguccugucgucuguucauucccagacgacucgcccga

SEQ ID NO: 3309 - RNA, 51 nt, Artificial Sequence
  Description of Artificial Sequence: Synthetic oligonucleotide
gggaggacgaugcgguccugucgucuguucgaccacagacgacucgcccga

SEQ ID NO: 3310 - RNA, 51 nt, Artificial Sequence
  Description of Artificial Sequence: Synthetic oligonucleotide
gggaggacgaugcgguccugucgucuguucggacccagacgacucgcccga

SEQ ID NO: 3311 - RNA, 52 nt, Artificial Sequence
  Description of Artificial Sequence: Synthetic oligonucleotide
gggaggacgaugcgguccugucgucuguucgguccccagacgacucgcccga

SEQ ID NO: 3312 - RNA, 50 nt, Artificial Sequence
  Description of Artificial Sequence: Synthetic oligonucleotide
gggaggacgaugcgguccugucgucuguucguaccagacgacucgcccga

SEQ ID NO: 3313 - RNA, 51 nt, Artificial Sequence
  Description of Artificial Sequence: Synthetic oligonucleotide
gggaggacgaugcgguccugucgucuguucgucuacagacgacucgcccga

SEQ ID NO: 3314 - RNA, 51 nt, Artificial Sequence
  Description of Artificial Sequence: Synthetic oligonucleotide
gggaggacgaugcgguccugucgucuguucgucugcagacgacucgcccga

SEQ ID NO: 3315 - RNA, 51 nt, Artificial Sequence
  Description of Artificial Sequence: Synthetic oligonucleotide
gggaggacgaugcgguccugucgucuguucguuuucagacgacucgcccga

SEQ ID NO: 3316 - RNA, 50 nt, Artificial Sequence
  Description of Artificial Sequence: Synthetic oligonucleotide
gggaggacgaugcgguccugucgucuguuugucccagacgacucgcccga

SEQ ID NO: 3317 - RNA, 50 nt, Artificial Sequence
  Description of Artificial Sequence: Synthetic oligonucleotide
gggaggacgaugcgguccugucgucuuacguccccagacgacucgcccga

SEQ ID NO: 3318 - RNA, 49 nt, Artificial Sequence
  Description of Artificial Sequence: Synthetic oligonucleotide
gggaggacgaugcgguccugucguguucguccccagacgacucgcccga

SEQ ID NO: 3319 - RNA, 51 nt, Artificial Sequence
  Description of Artificial Sequence: Synthetic oligonucleotide
gggaggacgaugcgguccugucguuuguuaguccccagacgacucgcccga

SEQ ID NO: 3320 - RNA, 51 nt, Artificial Sequence
  Description of Artificial Sequence: Synthetic oligonucleotide
gggaggacgaugcgguccugucguuuguucgcccccagacgacucgcccga

SEQ ID NO: 3321 - RNA, 51 nt, Artificial Sequence
  Description of Artificial Sequence: Synthetic oligonucleotide
gggaggacgaugcgguccugucguuuguucguacccagacgacucgcccga

SEQ ID NO: 3322 - RNA, 51 nt, Artificial Sequence
  Description of Artificial Sequence: Synthetic oligonucleotide
gggaggacgaugcgguccuuucguuuguucguccccagacgacucgcccga

SEQ ID NO: 3323 - RNA, 51 nt, Artificial Sequence
  Description of Artificial Sequence: Synthetic oligonucleotide
gggaggacgaugcggucgauucuucugugucuccccagacgacucgcccga

SEQ ID NO: 3324 - RNA, 49 nt, Artificial Sequence
  Description of Artificial Sequence: Synthetic oligonucleotide
gggaggacgaugcggucgucgucuguucguccccagacgacucgcccga

SEQ ID NO: 3325 - RNA, 51 nt, Artificial Sequence
  Description of Artificial Sequence: Synthetic oligonucleotide
gggaggacgaugcggucguugucgucuagccuccccagacgacucgcccga

SEQ ID NO: 3326 - RNA, 51 nt, Artificial Sequence
  Description of Artificial Sequence: Synthetic oligonucleotide
gggaggacgaugcggucuuaucgucuguucguccccagacgacucgcccga

SEQ ID NO: 3327 - RNA, 51 nt, Artificial Sequence
  Description of Artificial Sequence: Synthetic oligonucleotide
gggaggacgaugcggucuuggcuugucguuguccccagacgacucgcccga

SEQ ID NO: 3328 - RNA, 51 nt, Artificial Sequence
  Description of Artificial Sequence: Synthetic oligonucleotide
gggaggacgaugcggucuugucgucugaucguccccagacgacucgcccga

SEQ ID NO: 3329 - RNA, 51 nt, Artificial Sequence
  Description of Artificial Sequence: Synthetic oligonucleotide
gggaggacgaugcggucuugucgucuguucgucaccagacgacucgcccga

SEQ ID NO: 3330 - RNA, 51 nt, Artificial Sequence
  Description of Artificial Sequence: Synthetic oligonucleotide
gggaggacgaugcggucuuuucgucuguucguccccagacgacucgcccga

SEQ ID NO: 3331 - RNA, 51 nt, Artificial Sequence
  Description of Artificial Sequence: Synthetic oligonucleotide
gggaggacgaugcggugaaguucgucugugcuccccagacgacucgcccga

SEQ ID NO: 3332 - RNA, 51 nt, Artificial Sequence
  Description of Artificial Sequence: Synthetic oligonucleotide
gggaggacgaugcggugaguccucuguuucguccccagacgacucgcccga

SEQ ID NO: 3333 - RNA, 51 nt, Artificial Sequence
  Description of Artificial Sequence: Synthetic oligonucleotide
gggaggacgaugcggugagucguccccuucguccccagacgacucgcccga

SEQ ID NO: 3334 - RNA, 50 nt, Artificial Sequence
  Description of Artificial Sequence: Synthetic oligonucleotide
gggaggacgaugcggugagucguucccuucgucccagacgacucgcccga

SEQ ID NO: 3335 - RNA, 51 nt, Artificial Sequence
  Description of Artificial Sequence: Synthetic oligonucleotide
gggaggacgaugcggugagucguucccuucguucccagacgacucgcccga

SEQ ID NO: 3336 - RNA, 51 nt, Artificial Sequence
  Description of Artificial Sequence: Synthetic oligonucleotide
gggaggacgaugcggugagucguucccuucguuuccagacgacucgcccga

SEQ ID NO: 3337 - RNA, 51 nt, Artificial Sequence
  Description of Artificial Sequence: Synthetic oligonucleotide
gggaggacgaugcggugaugucgucuuugcguccccagacgacucgcccga

SEQ ID NO: 3338 - RNA, 50 nt, Artificial Sequence
  Description of Artificial Sequence: Synthetic oligonucleotide
gggaggacgaugcggugcugucgucuguucgucccagacgacucgcccga

SEQ ID NO: 3339 - RNA, 51 nt, Artificial Sequence
  Description of Artificial Sequence: Synthetic oligonucleotide
gggaggacgaugcggugcugucgucuguucguucccagacgacucgcccga

SEQ ID NO: 3340 - RNA, 51 nt, Artificial Sequence
  Description of Artificial Sequence: Synthetic oligonucleotide
gggaggacgaugcgguguguugucuguugccuccccagacgacucgcccga

SEQ ID NO: 3341 - RNA, 51 nt, Artificial Sequence
  Description of Artificial Sequence: Synthetic oligonucleotide
gggaggacgaugcgguuugggauuuucccgugccccagacgacucgcccga

SEQ ID NO: 3342 - RNA, 51 nt, Artificial Sequence
  Description of Artificial Sequence: Synthetic oligonucleotide
gggaggacgaugcgguuuggggucuuucccugccccagacgacucgcccga

SEQ ID NO: 3343 - RNA, 51 nt, Artificial Sequence
  Description of Artificial Sequence: Synthetic oligonucleotide
gggaggacgaugcgguuugggguuucuccccgccccagacgacucgcccga

SEQ ID NO: 3344 - RNA, 50 nt, Artificial Sequence
  Description of Artificial Sequence: Synthetic oligonucleotide
gggaggacgaugcgguuugucgucuguucguccccagacgacucgcccga

SEQ ID NO: 3345 - RNA, 51 nt, Artificial Sequence
  Description of Artificial Sequence: Synthetic oligonucleotide
gggaggacgaugcggauguauguugggggccacgccagacgacucgcccga

SEQ ID NO: 3346 - RNA, 51 nt, Artificial Sequence
  Description of Artificial Sequence: Synthetic oligonucleotide
gggaggacgaugcgggcccucguuugguucguccccagacgacucgcccga

SEQ ID NO: 3347 - RNA, 50 nt, Artificial Sequence
  Description of Artificial Sequence: Synthetic oligonucleotide
gggaggacgaugcgguccugucguccguucgucccagacgacucgcccga

SEQ ID NO: 3348 - RNA, 51 nt, Artificial Sequence
  Description of Artificial Sequence: Synthetic oligonucleotide
gggaggacgaugcgguucugucgucuguucgucuccagacgacucgcccga

SEQ ID NO: 3349 - RNA, 51 nt, Artificial Sequence
  Description of Artificial Sequence: Synthetic oligonucleotide
gggaggacgaugcgguuugggguuuucccgugcuccagacgacucgcccga

SEQ ID NO: 3350 - RNA, 50 nt, Artificial Sequence
  Description of Artificial Sequence: Synthetic oligonucleotide
gggaggacgaugcgguuugggguuuuucgugccccagacgacucgcccga

SEQ ID NO: 3351 - RNA, 51 nt, Artificial Sequence
  Description of Artificial Sequence: Synthetic oligonucleotide
gggaggacgaugcgguauauguucgucacucgcugcagacgacucgcccga

SEQ ID NO: 3352 - RNA, 51 nt, Artificial Sequence
  Description of Artificial Sequence: Synthetic oligonucleotide
gggaggacgaugcggucugacgagacucccaucgccagacgacucgcccga

SEQ ID NO: 3353 - RNA, 51 nt, Artificial Sequence
  Description of Artificial Sequence: Synthetic oligonucleotide
gggaggacgaugcgguuugggguauuccucggccccagacgacucgcccga

SEQ ID NO: 3354 - RNA, 51 nt, Artificial Sequence
  Description of Artificial Sequence: Synthetic oligonucleotide
gggaggacgaugcgguuuggguuuuucccgugccccagacgacucgcccga

SEQ ID NO: 3355 - RNA, 51 nt, Artificial Sequence
  Description of Artificial Sequence: Synthetic oligonucleotide
gggaggacgaugcggucuacacagugucccgugugcagacgacucgcccga

SEQ ID NO: 3356 - RNA, 51 nt, Artificial Sequence
  Description of Artificial Sequence: Synthetic oligonucleotide
gggaggacgaugcggaccugacgucuguucguccccagacgacucgcccga

SEQ ID NO: 3357 - RNA, 51 nt, Artificial Sequence
  Description of Artificial Sequence: Synthetic oligonucleotide
gggaggacgaugcggaccuggcuugucguuguccccagacgacucgcccga

SEQ ID NO: 3358 - RNA, 51 nt, Artificial Sequence
  Description of Artificial Sequence: Synthetic oligonucleotide
gggaggacgaugcggaccugucgucugaucguccccagacgacucgcccga

SEQ ID NO: 3359 - RNA, 51 nt, Artificial Sequence
  Description of Artificial Sequence: Synthetic oligonucleotide
gggaggacgaugcggaccugucgucuguucauccccagacgacucgcccga

SEQ ID NO: 3360 - RNA, 51 nt, Artificial Sequence
  Description of Artificial Sequence: Synthetic oligonucleotide
gggaggacgaugcggaccuugucgucugaccuccccagacgacucgcccga

SEQ ID NO: 3361 - RNA, 51 nt, Artificial Sequence
  Description of Artificial Sequence: Synthetic oligonucleotide
gggaggacgaugcggacucgucugguuugccgcgccagacgacucgcccga

SEQ ID NO: 3362 - RNA, 51 nt, Artificial Sequence
  Description of Artificial Sequence: Synthetic oligonucleotide
gggaggacgaugcggauauccagucuauggccccgcagacgacucgcccga

SEQ ID NO: 3363 - RNA, 51 nt, Artificial Sequence
  Description of Artificial Sequence: Synthetic oligonucleotide
gggaggacgaugcggaucugggguuuucccugccccagacgacucgcccga

SEQ ID NO: 3364 - RNA, 51 nt, Artificial Sequence
  Description of Artificial Sequence: Synthetic oligonucleotide
gggaggacgaugcggcacaguucgucugcgcuccccagacgacucgcccga

SEQ ID NO: 3365 - RNA, 51 nt, Artificial Sequence
  Description of Artificial Sequence: Synthetic oligonucleotide
gggaggacgaugcggcagaucgucuguugccuccccagacgacucgcccga

SEQ ID NO: 3366 - RNA, 52 nt, Artificial Sequence
  Description of Artificial Sequence: Synthetic oligonucleotide
gggaggacgaugcggcagucgucuuuuuuugucccccagacgacucgcccga

SEQ ID NO: 3367 - RNA, 51 nt, Artificial Sequence
  Description of Artificial Sequence: Synthetic oligonucleotide
gggaggacgaugcggccaguugaucugucccuccccagacgacucgcccga

SEQ ID NO: 3368 - RNA, 51 nt, Artificial Sequence
  Description of Artificial Sequence: Synthetic oligonucleotide
gggaggacgaugcggcccugacgucuguucguccccagacgacucgcccga

SEQ ID NO: 3369 - RNA, 51 nt, Artificial Sequence
  Description of Artificial Sequence: Synthetic oligonucleotide
gggaggacgaugcggcccugucgucuguucgaccccagacgacucgcccga

SEQ ID NO: 3370 - RNA, 51 nt, Artificial Sequence
  Description of Artificial Sequence: Synthetic oligonucleotide
gggaggacgaugcggcccugucgucuguucggccccagacgacucgcccga

SEQ ID NO: 3371 - RNA, 50 nt, Artificial Sequence
  Description of Artificial Sequence: Synthetic oligonucleotide
gggaggacgaugcggcccugucgucuguucguuccagacgacucgcccga

SEQ ID NO: 3372 - RNA, 52 nt, Artificial Sequence
  Description of Artificial Sequence: Synthetic oligonucleotide
gggaggacgaugcggcccugucgucuguucguuccccagacgacucgcccga

SEQ ID NO: 3373 - RNA, 51 nt, Artificial Sequence
  Description of Artificial Sequence: Synthetic oligonucleotide
gggaggacgaugcggcccugucgucuguugguccccagacgacucgcccga

SEQ ID NO: 3374 - RNA, 51 nt, Artificial Sequence
  Description of Artificial Sequence: Synthetic oligonucleotide
gggaggacgaugcggcccuucgucuguucucuccccagacgacucgcccga

SEQ ID NO: 3375 - RNA, 51 nt, Artificial Sequence
  Description of Artificial Sequence: Synthetic oligonucleotide
gggaggacgaugcggccgcucuuuccuucccuccccagacgacucgcccga

SEQ ID NO: 3376 - RNA, 51 nt, Artificial Sequence
  Description of Artificial Sequence: Synthetic oligonucleotide
gggaggacgaugcggccgucgucuguuguucuccccagacgacucgcccga

SEQ ID NO: 3377 - RNA, 51 nt, Artificial Sequence
  Description of Artificial Sequence: Synthetic oligonucleotide
gggaggacgaugcggccugucgucaugcugcuccccagacgacucgcccga

SEQ ID NO: 3378 - RNA, 53 nt, Artificial Sequence
  Description of Artificial Sequence: Synthetic oligonucleotide
gggaggacgaugcggccugucgucuuuuuuucguccccagacgacucgcccga

SEQ ID NO: 3379 - RNA, 51 nt, Artificial Sequence
  Description of Artificial Sequence: Synthetic oligonucleotide
gggaggacgaugcggcgacacguucuggaccuccccagacgacucgcccga

SEQ ID NO: 3380 - RNA, 51 nt, Artificial Sequence
  Description of Artificial Sequence: Synthetic oligonucleotide
gggaggacgaugcggcgacgaucgucugaccuccccagacgacucgcccga

SEQ ID NO: 3381 - RNA, 51 nt, Artificial Sequence
  Description of Artificial Sequence: Synthetic oligonucleotide
gggaggacgaugcggcgacgucuucuguucguccccagacgacucgcccga

SEQ ID NO: 3382 - RNA, 51 nt, Artificial Sequence
  Description of Artificial Sequence: Synthetic oligonucleotide
gggaggacgaugcggcgacucccgucuguacuccccagacgacucgcccga

SEQ ID NO: 3383 - RNA, 51 nt, Artificial Sequence
  Description of Artificial Sequence: Synthetic oligonucleotide
gggaggacgaugcggcgacucgucaaccucguccccagacgacucgcccga

SEQ ID NO: 3384 - RNA, 51 nt, Artificial Sequence
  Description of Artificial Sequence: Synthetic oligonucleotide
gggaggacgaugcggcgauacucguuugcgcuccccagacgacucgcccga

SEQ ID NO: 3385 - RNA, 51 nt, Artificial Sequence
  Description of Artificial Sequence: Synthetic oligonucleotide
gggaggacgaugcggcgaucgaucugccucuuccccagacgacucgcccga

SEQ ID NO: 3386 - RNA, 51 nt, Artificial Sequence
  Description of Artificial Sequence: Synthetic oligonucleotide
gggaggacgaugcggcgaucguucuguuacguccccagacgacucgcccga

SEQ ID NO: 3387 - RNA, 51 nt, Artificial Sequence
  Description of Artificial Sequence: Synthetic oligonucleotide
gggaggacgaugcggcgauucucuguucuucuccccagacgacucgcccga

SEQ ID NO: 3388 - RNA, 51 nt, Artificial Sequence
  Description of Artificial Sequence: Synthetic oligonucleotide
gggaggacgaugcggcgcgaucguuugcaccuccccagacgacucgcccga

SEQ ID NO: 3389 - RNA, 51 nt, Artificial Sequence
  Description of Artificial Sequence: Synthetic oligonucleotide
gggaggacgaugcggcgcguucucuguauccuccccagacgacucgcccga

SEQ ID NO: 3390 - RNA, 51 nt, Artificial Sequence
  Description of Artificial Sequence: Synthetic oligonucleotide
gggaggacgaugcggcggucguuugauuucguccccagacgacucgcccga

SEQ ID NO: 3391 - RNA, 51 nt, Artificial Sequence
  Description of Artificial Sequence: Synthetic oligonucleotide
gggaggacgaugcggcguuuacucugguucguccccagacgacucgcccga

SEQ ID NO: 3392 - RNA, 51 nt, Artificial Sequence
  Description of Artificial Sequence: Synthetic oligonucleotide
gggaggacgaugcggcguuuccucugguucauccccagacgacucgcccga

SEQ ID NO: 3393 - RNA, 51 nt, Artificial Sequence
  Description of Artificial Sequence: Synthetic oligonucleotide
gggaggacgaugcggcuacucgucugaacccuccccagacgacucgcccga

SEQ ID NO: 3394 - RNA, 52 nt, Artificial Sequence
  Description of Artificial Sequence: Synthetic oligonucleotide
gggaggacgaugcggcuccugucgucuguucguccccagacgacucgcccga

SEQ ID NO: 3395 - RNA, 51 nt, Artificial Sequence
  Description of Artificial Sequence: Synthetic oligonucleotide
gggaggacgaugcggcucgaguugucugcccuccccagacgacucgcccga

SEQ ID NO: 3396 - RNA, 51 nt, Artificial Sequence
  Description of Artificial Sequence: Synthetic oligonucleotide
gggaggacgaugcggcugauuucgucugaccuccccagacgacucgcccga

SEQ ID NO: 3397 - RNA, 51 nt, Artificial Sequence
  Description of Artificial Sequence: Synthetic oligonucleotide
gggaggacgaugcggcuguuccggcugcguugguccagacgacucgcccga

SEQ ID NO: 3398 - RNA, 51 nt, Artificial Sequence
  Description of Artificial Sequence: Synthetic oligonucleotide
gggaggacgaugcggcuugucgaucugugugccgccagacgacucgcccga

SEQ ID NO: 3399 - RNA, 51 nt, Artificial Sequence
  Description of Artificial Sequence: Synthetic oligonucleotide
gggaggacgaugcggcuuguugucugauaccuccccagacgacucgcccga

SEQ ID NO: 3400 - RNA, 51 nt, Artificial Sequence
  Description of Artificial Sequence: Synthetic oligonucleotide
gggaggacgaugcgggaccuucgucugcugcuccccagacgacucgcccga

SEQ ID NO: 3401 - RNA, 51 nt, Artificial Sequence
  Description of Artificial Sequence: Synthetic oligonucleotide
gggaggacgaugcgggcacgaucguuugcacuccccagacgacucgcccga

SEQ ID NO: 3402 - RNA, 51 nt, Artificial Sequence
  Description of Artificial Sequence: Synthetic oligonucleotide
gggaggacgaugcgggcagcggugguagucuaucccagacgacucgcccga

SEQ ID NO: 3403 - RNA, 51 nt, Artificial Sequence
  Description of Artificial Sequence: Synthetic oligonucleotide
gggaggacgaugcgggccauucgucuguucguccccagacgacucgcccga

SEQ ID NO: 3404 - RNA, 51 nt, Artificial Sequence
  Description of Artificial Sequence: Synthetic oligonucleotide
gggaggacgaugcgggccauucgucuugcgucccccagacgacucgcccga

SEQ ID NO: 3405 - RNA, 51 nt, Artificial Sequence
  Description of Artificial Sequence: Synthetic oligonucleotide
gggaggacgaugcgggcccaguugucuugccuccccagacgacucgcccga

SEQ ID NO: 3406 - RNA, 51 nt, Artificial Sequence
  Description of Artificial Sequence: Synthetic oligonucleotide
gggaggacgaugcgggcccucgucuuuucccuccccagacgacucgcccga

SEQ ID NO: 3407 - RNA, 51 nt, Artificial Sequence
  Description of Artificial Sequence: Synthetic oligonucleotide
gggaggacgaugcgggccgaguucuguagccgcaccagacgacucgcccga

SEQ ID NO: 3408 - RNA, 51 nt, Artificial Sequence
  Description of Artificial Sequence: Synthetic oligonucleotide
gggaggacgaugcgggccguccuuuuuccccuccccagacgacucgcccga

SEQ ID NO: 3409 - RNA, 51 nt, Artificial Sequence
  Description of Artificial Sequence: Synthetic oligonucleotide
gggaggacgaugcgggccucagucguucuacuccccagacgacucgcccga

SEQ ID NO: 3410 - RNA, 51 nt, Artificial Sequence
  Description of Artificial Sequence: Synthetic oligonucleotide
gggaggacgaugcgggccucgaucuguucccuccccagacgacucgcccga

SEQ ID NO: 3411 - RNA, 51 nt, Artificial Sequence
  Description of Artificial Sequence: Synthetic oligonucleotide
gggaggacgaugcgggccucucgucuauccguccccagacgacucgcccga

SEQ ID NO: 3412 - RNA, 51 nt, Artificial Sequence
  Description of Artificial Sequence: Synthetic oligonucleotide
gggaggacgaugcgggccucucgucugcaccuccccagacgacucgcccga

SEQ ID NO: 3413 - RNA, 51 nt, Artificial Sequence
  Description of Artificial Sequence: Synthetic oligonucleotide
gggaggacgaugcgggccucucugucugcacuccccagacgacucgcccga

SEQ ID NO: 3414 - RNA, 51 nt, Artificial Sequence
  Description of Artificial Sequence: Synthetic oligonucleotide
gggaggacgaugcgggccuucguuuguuucguccccagacgacucgcccga

SEQ ID NO: 3415 - RNA, 51 nt, Artificial Sequence
  Description of Artificial Sequence: Synthetic oligonucleotide
gggaggacgaugcgggccuucucgccuguuguccccagacgacucgcccga

SEQ ID NO: 3416 - RNA, 51 nt, Artificial Sequence
  Description of Artificial Sequence: Synthetic oligonucleotide
gggaggacgaugcgggccuucucgucugaucuccccagacgacucgcccga

SEQ ID NO: 3417 - RNA, 51 nt, Artificial Sequence
  Description of Artificial Sequence: Synthetic oligonucleotide
gggaggacgaugcgggccuucucgucuguuguucccagacgacucgcccga

SEQ ID NO: 3418 - RNA, 51 nt, Artificial Sequence
  Description of Artificial Sequence: Synthetic oligonucleotide
gggaggacgaugcgggccuuucguucugaccuucccagacgacucgcccga

SEQ ID NO: 3419 - RNA, 51 nt, Artificial Sequence
  Description of Artificial Sequence: Synthetic oligonucleotide
gggaggacgaugcgggccuuucucugguucguccccagacgacucgcccga

SEQ ID NO: 3420 - RNA, 51 nt, Artificial Sequence
  Description of Artificial Sequence: Synthetic oligonucleotide
gggaggacgaugcgggcgcgcuucugcuaucuccccagacgacucgcccga

SEQ ID NO: 3421 - RNA, 51 nt, Artificial Sequence
  Description of Artificial Sequence: Synthetic oligonucleotide
gggaggacgaugcgggcguucccucuguucguccccagacgacucgcccga

SEQ ID NO: 3422 - RNA, 51 nt, Artificial Sequence
  Description of Artificial Sequence: Synthetic oligonucleotide
gggaggacgaugcgggcguuuccuauguucguccccagacgacucgcccga

SEQ ID NO: 3423 - RNA, 51 nt, Artificial Sequence
  Description of Artificial Sequence: Synthetic oligonucleotide
gggaggacgaugcgggcguuucucugcugucuccccagacgacucgcccga

SEQ ID NO: 3424 - RNA, 51 nt, Artificial Sequence
  Description of Artificial Sequence: Synthetic oligonucleotide
gggaggacgaugcgggcucacucgucugaccuccccagacgacucgcccga

SEQ ID NO: 3425 - RNA, 51 nt, Artificial Sequence
  Description of Artificial Sequence: Synthetic oligonucleotide
gggaggacgaugcgggcuucgaucuguggccuccccagacgacucgcccga

SEQ ID NO: 3426 - RNA, 51 nt, Artificial Sequence
  Description of Artificial Sequence: Synthetic oligonucleotide
gggaggacgaugcgggcuucucguucuguacuccccagacgacucgcccga

SEQ ID NO: 3427 - RNA, 51 nt, Artificial Sequence
  Description of Artificial Sequence: Synthetic oligonucleotide
gggaggacgaugcgggcuugaaucgucuaccuccccagacgacucgcccga

SEQ ID NO: 3428 - RNA, 51 nt, Artificial Sequence
  Description of Artificial Sequence: Synthetic oligonucleotide
gggaggacgaugcgggcuuguccucuguucguccccagacgacucgcccga

SEQ ID NO: 3429 - RNA, 51 nt, Artificial Sequence
  Description of Artificial Sequence: Synthetic oligonucleotide
gggaggacgaugcgggcuuucgucuauuugucccccagacgacucgcccga

SEQ ID NO: 3430 - RNA, 51 nt, Artificial Sequence
  Description of Artificial Sequence: Synthetic oligonucleotide
gggaggacgaugcgggcuuuucgucuccagucccccagacgacucgcccga

SEQ ID NO: 3431 - RNA, 52 nt, Artificial Sequence
  Description of Artificial Sequence: Synthetic oligonucleotide
gggaggacgaugcggguacugucgucuguucguccccagacgacucgcccga

SEQ ID NO: 3432 - RNA, 51 nt, Artificial Sequence
  Description of Artificial Sequence: Synthetic oligonucleotide
gggaggacgaugcggguagucuucuguuuccuccccagacgacucgcccga

SEQ ID NO: 3433 - RNA, 52 nt, Artificial Sequence
  Description of Artificial Sequence: Synthetic oligonucleotide
gggaggacgaugcggguccggucgucuguucguccccagacgacucgcccga

SEQ ID NO: 3434 - RNA, 52 nt, Artificial Sequence
  Description of Artificial Sequence: Synthetic oligonucleotide
gggaggacgaugcggguccugucgucuguucgucgccagacgacucgcccga

SEQ ID NO: 3435 - RNA, 51 nt, Artificial Sequence
  Description of Artificial Sequence: Synthetic oligonucleotide
gggaggacgaugcgggucuucgucugcugcuuccccagacgacucgcccga

SEQ ID NO: 3436 - RNA, 51 nt, Artificial Sequence
  Description of Artificial Sequence: Synthetic oligonucleotide
gggaggacgaugcgggugaagaucgucuaccuccccagacgacucgcccga

SEQ ID NO: 3437 - RNA, 51 nt, Artificial Sequence
  Description of Artificial Sequence: Synthetic oligonucleotide
gggaggacgaugcgggugacuccucuguuccgccccagacgacucgcccga

SEQ ID NO: 3438 - RNA, 51 nt, Artificial Sequence
  Description of Artificial Sequence: Synthetic oligonucleotide
gggaggacgaugcgggugauguucgucgcucuccccagacgacucgcccga

SEQ ID NO: 3439 - RNA, 51 nt, Artificial Sequence
  Description of Artificial Sequence: Synthetic oligonucleotide
gggaggacgaugcgggugauucguccguaccuccccagacgacucgcccga

SEQ ID NO: 3440 - RNA, 51 nt, Artificial Sequence
  Description of Artificial Sequence: Synthetic oligonucleotide
gggaggacgaugcgggugauucgucucuccguccccagacgacucgcccga

SEQ ID NO: 3441 - RNA, 51 nt, Artificial Sequence
  Description of Artificial Sequence: Synthetic oligonucleotide
gggaggacgaugcgggugcuucgucuguucguccccagacgacucgcccga

SEQ ID NO: 3442 - RNA, 51 nt, Artificial Sequence
  Description of Artificial Sequence: Synthetic oligonucleotide
gggaggacgaugcggguggagcugaacccucuggccagacgacucgcccga

SEQ ID NO: 3443 - RNA, 51 nt, Artificial Sequence
  Description of Artificial Sequence: Synthetic oligonucleotide
gggaggacgaugcggguugcugucgucgcuguccccagacgacucgcccga

SEQ ID NO: 3444 - RNA, 51 nt, Artificial Sequence
  Description of Artificial Sequence: Synthetic oligonucleotide
gggaggacgaugcgguacugucguauguucguacccagacgacucgcccga

SEQ ID NO: 3445 - RNA, 51 nt, Artificial Sequence
  Description of Artificial Sequence: Synthetic oligonucleotide
gggaggacgaugcggucaugucgucuguucguaaccagacgacucgcccga

SEQ ID NO: 3446 - RNA, 51 nt, Artificial Sequence
  Description of Artificial Sequence: Synthetic oligonucleotide
gggaggacgaugcgguccagucgucuauucguccccagacgacucgcccga

SEQ ID NO: 3447 - RNA, 51 nt, Artificial Sequence
  Description of Artificial Sequence: Synthetic oligonucleotide
gggaggacgaugcgguccagucgucuguucguucccagacgacucgcccga

SEQ ID NO: 3448 - RNA, 51 nt, Artificial Sequence
  Description of Artificial Sequence: Synthetic oligonucleotide
gggaggacgaugcggucccgccgucuguucguccccagacgacucgcccga

SEQ ID NO: 3449 - RNA, 51 nt, Artificial Sequence
  Description of Artificial Sequence: Synthetic oligonucleotide
gggaggacgaugcggucccgucaucuguucguccccagacgacucgcccga

SEQ ID NO: 3450 - RNA, 51 nt, Artificial Sequence
  Description of Artificial Sequence: Synthetic oligonucleotide
gggaggacgaugcggucccgucgucuguucauccccagacgacucgcccga

SEQ ID NO: 3451 - RNA, 51 nt, Artificial Sequence
  Description of Artificial Sequence: Synthetic oligonucleotide
gggaggacgaugcggucccgucgucuguucguuuccagacgacucgcccga

SEQ ID NO: 3452 - RNA, 51 nt, Artificial Sequence
  Description of Artificial Sequence: Synthetic oligonucleotide
gggaggacgaugcgguccuaucgucuguucauccccagacgacucgcccga

SEQ ID NO: 3453 - RNA, 51 nt, Artificial Sequence
  Description of Artificial Sequence: Synthetic oligonucleotide
gggaggacgaugcgguccucucgucugcucguccccagacgacucgcccga

SEQ ID NO: 3454 - RNA, 51 nt, Artificial Sequence
  Description of Artificial Sequence: Synthetic oligonucleotide
gggaggacgaugcgguccugacgucuguucgaccccagacgacucgcccga

SEQ ID NO: 3455 - RNA, 51 nt, Artificial Sequence
  Description of Artificial Sequence: Synthetic oligonucleotide
gggaggacgaugcgguccugccgucugcucguccccagacgacucgcccga

SEQ ID NO: 3456 - RNA, 50 nt, Artificial Sequence
  Description of Artificial Sequence: Synthetic oligonucleotide
gggaggacgaugcgguccugccgucuguucgucccagacgacucgcccga

SEQ ID NO: 3457 - RNA, 51 nt, Artificial Sequence
  Description of Artificial Sequence: Synthetic oligonucleotide
gggaggacgaugcgguccugccuugucguuguccccagacgacucgcccga

SEQ ID NO: 3458 - RNA, 51 nt, Artificial Sequence
  Description of Artificial Sequence: Synthetic oligonucleotide
gggaggacgaugcgguccuggcuagucguuguccccagacgacucgcccga

SEQ ID NO: 3459 - RNA, 51 nt, Artificial Sequence
  Description of Artificial Sequence: Synthetic oligonucleotide
gggaggacgaugcgguccuggcuugucgugguccccagacgacucgcccga

SEQ ID NO: 3460 - RNA, 51 nt, Artificial Sequence
  Description of Artificial Sequence: Synthetic oligonucleotide
gggaggacgaugcgguccuggcuugucguugaccccagacgacucgcccga

SEQ ID NO: 3461 - RNA, 51 nt, Artificial Sequence
  Description of Artificial Sequence: Synthetic oligonucleotide
gggaggacgaugcgguccuguaguauguucgucaccagacgacucgcccga

SEQ ID NO: 3462 - RNA, 51 nt, Artificial Sequence
  Description of Artificial Sequence: Synthetic oligonucleotide
gggaggacgaugcgguccuguagucuguucauccccagacgacucgcccga

SEQ ID NO: 3463 - RNA, 51 nt, Artificial Sequence
  Description of Artificial Sequence: Synthetic oligonucleotide
gggaggacgaugcgguccuguagucuguuuguccccagacgacucgcccga

SEQ ID NO: 3464 - RNA, 51 nt, Artificial Sequence
  Description of Artificial Sequence: Synthetic oligonucleotide
gggaggacgaugcgguccugucaucuguucgcccccagacgacucgcccga

SEQ ID NO: 3465 - RNA, 51 nt, Artificial Sequence
  Description of Artificial Sequence: Synthetic oligonucleotide
gggaggacgaugcgguccugucaucuguucguucccagacgacucgcccga

SEQ ID NO: 3466 - RNA, 51 nt, Artificial Sequence
  Description of Artificial Sequence: Synthetic oligonucleotide
gggaggacgaugcgguccugucguauguucgucaacagacgacucgcccga

SEQ ID NO: 3467 - RNA, 51 nt, Artificial Sequence
  Description of Artificial Sequence: Synthetic oligonucleotide
gggaggacgaugcgguccugucgucaguucguccacagacgacucgcccga

SEQ ID NO: 3468 - RNA, 51 nt, Artificial Sequence
  Description of Artificial Sequence: Synthetic oligonucleotide
gggaggacgaugcgguccugucguccgcucguccccagacgacucgcccga

SEQ ID NO: 3469 - RNA, 50 nt, Artificial Sequence
  Description of Artificial Sequence: Synthetic oligonucleotide
gggaggacgaugcgguccugucguccuucguccccagacgacucgcccga

SEQ ID NO: 3470 - RNA, 51 nt, Artificial Sequence
  Description of Artificial Sequence: Synthetic oligonucleotide
gggaggacgaugcgguccugucguccuuucguccccagacgacucgcccga

SEQ ID NO: 3471 - RNA, 51 nt, Artificial Sequence
  Description of Artificial Sequence: Synthetic oligonucleotide
gggaggacgaugcgguccugucgucuauuccuccccagacgacucgcccga

SEQ ID NO: 3472 - RNA, 51 nt, Artificial Sequence
  Description of Artificial Sequence: Synthetic oligonucleotide
gggaggacgaugcgguccugucgucucuuuguccccagacgacucgcccga

SEQ ID NO: 3473 - RNA, 51 nt, Artificial Sequence
  Description of Artificial Sequence: Synthetic oligonucleotide
gggaggacgaugcgguccugucgucugaucguccacagacgacucgcccga

SEQ ID NO: 3474 - RNA, 50 nt, Artificial Sequence
  Description of Artificial Sequence: Synthetic oligonucleotide
gggaggacgaugcgguccugucgucugucccccccagacgacucgcccga

SEQ ID NO: 3475 - RNA, 50 nt, Artificial Sequence
  Description of Artificial Sequence: Synthetic oligonucleotide
gggaggacgaugcgguccugucgucugucgcccccagacgacucgcccga

SEQ ID NO: 3476 - RNA, 50 nt, Artificial Sequence
  Description of Artificial Sequence: Synthetic oligonucleotide
gggaggacgaugcgguccugucgucugucguuuccagacgacucgcccga

SEQ ID NO: 3477 - RNA, 51 nt, Artificial Sequence
  Description of Artificial Sequence: Synthetic oligonucleotide
gggaggacgaugcgguccugucgucuguuaguaaccagacgacucgcccga

SEQ ID NO: 3478 - RNA, 51 nt, Artificial Sequence
  Description of Artificial Sequence: Synthetic oligonucleotide
gggaggacgaugcgguccugucgucuguuaguccucagacgacucgcccga

SEQ ID NO: 3479 - RNA, 51 nt, Artificial Sequence
  Description of Artificial Sequence: Synthetic oligonucleotide
gggaggacgaugcgguccugucgucuguucauacccagacgacucgcccga

SEQ ID NO: 3480 - RNA, 51 nt, Artificial Sequence
  Description of Artificial Sequence: Synthetic oligonucleotide
gggaggacgaugcgguccugucgucuguucgcacccagacgacucgcccga

SEQ ID NO: 3481 - RNA, 52 nt, Artificial Sequence
  Description of Artificial Sequence: Synthetic oligonucleotide
gggaggacgaugcgguccugucgucuguuguccccccagacgacucgcccga

SEQ ID NO: 3482 - RNA, 52 nt, Artificial Sequence
  Description of Artificial Sequence: Synthetic oligonucleotide
gggaggacgaugcgguccugucgucuguuuuguccccagacgacucgcccga

SEQ ID NO: 3483 - RNA, 51 nt, Artificial Sequence
  Description of Artificial Sequence: Synthetic oligonucleotide
gggaggacgaugcgguccugucguuuguucguccucagacgacucgcccga

SEQ ID NO: 3484 - RNA, 51 nt, Artificial Sequence
  Description of Artificial Sequence: Synthetic oligonucleotide
gggaggacgaugcgguccugucguuuguucgucuccagacgacucgcccga

SEQ ID NO: 3485 - RNA, 52 nt, Artificial Sequence
  Description of Artificial Sequence: Synthetic oligonucleotide
gggaggacgaugcgguccuguucgucuguucguccccagacgacucgcccga

SEQ ID NO: 3486 - RNA, 51 nt, Artificial Sequence
  Description of Artificial Sequence: Synthetic oligonucleotide
gggaggacgaugcgguccuguugucuguucgucuccagacgacucgcccga

SEQ ID NO: 3487 - RNA, 51 nt, Artificial Sequence
  Description of Artificial Sequence: Synthetic oligonucleotide
gggaggacgaugcgguccuguugucuguucguucccagacgacucgcccga

SEQ ID NO: 3488 - RNA, 51 nt, Artificial Sequence
  Description of Artificial Sequence: Synthetic oligonucleotide
gggaggacgaugcgguccuuucgucuguucuuccccagacgacucgcccga

SEQ ID NO: 3489 - RNA, 51 nt, Artificial Sequence
  Description of Artificial Sequence: Synthetic oligonucleotide
gggaggacgaugcgguccuuucgucuuuucguccccagacgacucgcccga

SEQ ID NO: 3490 - RNA, 51 nt, Artificial Sequence
  Description of Artificial Sequence: Synthetic oligonucleotide
gggaggacgaugcggucgacgucugcugccuuccccagacgacucgcccga

SEQ ID NO: 3491 - RNA, 51 nt, Artificial Sequence
  Description of Artificial Sequence: Synthetic oligonucleotide
gggaggacgaugcggucgaguucguucuaccuccccagacgacucgcccga

SEQ ID NO: 3492 - RNA, 52 nt, Artificial Sequence
  Description of Artificial Sequence: Synthetic oligonucleotide
gggaggacgaugcggucgcugucgucuguucguccccagacgacucgcccga

SEQ ID NO: 3493 - RNA, 51 nt, Artificial Sequence
  Description of Artificial Sequence: Synthetic oligonucleotide
gggaggacgaugcggucggagucuucuguugccgccagacgacucgcccga

SEQ ID NO: 3494 - RNA, 51 nt, Artificial Sequence
  Description of Artificial Sequence: Synthetic oligonucleotide
gggaggacgaugcggucucaguagugggccugcggcagacgacucgcccga

SEQ ID NO: 3495 - RNA, 51 nt, Artificial Sequence
  Description of Artificial Sequence: Synthetic oligonucleotide
gggaggacgaugcggucucuggguguucuccgccccagacgacucgcccga

SEQ ID NO: 3496 - RNA, 50 nt, Artificial Sequence
  Description of Artificial Sequence: Synthetic oligonucleotide
gggaggacgaugcggucugugugggauuuggccccagacgacucgcccga

SEQ ID NO: 3497 - RNA, 51 nt, Artificial Sequence
  Description of Artificial Sequence: Synthetic oligonucleotide
gggaggacgaugcggucuucucgucuguucguccccagacgacucgcccga

SEQ ID NO: 3498 - RNA, 51 nt, Artificial Sequence
  Description of Artificial Sequence: Synthetic oligonucleotide
gggaggacgaugcggucuugucgucaguucguccccagacgacucgcccga

SEQ ID NO: 3499 - RNA, 48 nt, Artificial Sequence
  Description of Artificial Sequence: Synthetic oligonucleotide
gggaggacgaugcggucuugucgucuguuccccagacgacucgcccga

SEQ ID NO: 3500 - RNA, 51 nt, Artificial Sequence
  Description of Artificial Sequence: Synthetic oligonucleotide
gggaggacgaugcggucuuguucgucugcccuccccagacgacucgcccga

SEQ ID NO: 3501 - RNA, 51 nt, Artificial Sequence
  Description of Artificial Sequence: Synthetic oligonucleotide
gggaggacgaugcggugagucguucccuucgcccccagacgacucgcccga

SEQ ID NO: 3502 - RNA, 51 nt, Artificial Sequence
  Description of Artificial Sequence: Synthetic oligonucleotide
gggaggacgaugcggugaguucucuguggccuccccagacgacucgcccga

SEQ ID NO: 3503 - RNA, 51 nt, Artificial Sequence
  Description of Artificial Sequence: Synthetic oligonucleotide
gggaggacgaugcggugcucucgucuguucuuccccagacgacucgcccga

SEQ ID NO: 3504 - RNA, 51 nt, Artificial Sequence
  Description of Artificial Sequence: Synthetic oligonucleotide
gggaggacgaugcggugcugucgucuguuuguccccagacgacucgcccga

SEQ ID NO: 3505 - RNA, 51 nt, Artificial Sequence
  Description of Artificial Sequence: Synthetic oligonucleotide
gggaggacgaugcggugcuguugucuguucguccccagacgacucgcccga

SEQ ID NO: 3506 - RNA, 51 nt, Artificial Sequence
  Description of Artificial Sequence: Synthetic oligonucleotide
gggaggacgaugcggugcuuucgucugcuccuccccagacgacucgcccga

SEQ ID NO: 3507 - RNA, 51 nt, Artificial Sequence
  Description of Artificial Sequence: Synthetic oligonucleotide
gggaggacgaugcggugugucgucugucucguccccagacgacucgcccga

SEQ ID NO: 3508 - RNA, 51 nt, Artificial Sequence
  Description of Artificial Sequence: Synthetic oligonucleotide
gggaggacgaugcgguucugucgucuguucguuuccagacgacucgcccga

SEQ ID NO: 3509 - RNA, 52 nt, Artificial Sequence
  Description of Artificial Sequence: Synthetic oligonucleotide
gggaggacgaugcgguuuggggguuuucccgugccccagacgacucgcccga

SEQ ID NO: 3510 - RNA, 51 nt, Artificial Sequence
  Description of Artificial Sequence: Synthetic oligonucleotide
gggaggacgaugcggccuucgucugguacccuccccagacgacucgcccga

SEQ ID NO: 3511 - RNA, 51 nt, Artificial Sequence
  Description of Artificial Sequence: Synthetic oligonucleotide
gggaggacgaugcggucggucugguuuuugcccgccagacgacucgcccga

SEQ ID NO: 3512 - RNA, 50 nt, Artificial Sequence
  Description of Artificial Sequence: Synthetic oligonucleotide
gggaggacgaugcggucucugugggauguggccccagacgacucgcccga

SEQ ID NO: 3513 - RNA, 49 nt, Artificial Sequence
  Description of Artificial Sequence: Synthetic oligonucleotide
gggaggacgaugcggucugugugggauguggcccagacgacucgcccga

SEQ ID NO: 3514 - RNA, 52 nt, Artificial Sequence
  Description of Artificial Sequence: Synthetic oligonucleotide
gggaggacgaugcgguuugggguuucucccgugccccagacgacucgcccga

SEQ ID NO: 3515 - RNA, 51 nt, Artificial Sequence
  Description of Artificial Sequence: Synthetic oligonucleotide
gggaggacgaugcgguuugggguuuuccagugccccagacgacucgcccga

SEQ ID NO: 3516 - RNA, 50 nt, Artificial Sequence
  Description of Artificial Sequence: Synthetic oligonucleotide
gggaggacgaugcgguuugggguuuucccggccccagacgacucgcccga

SEQ ID NO: 3517 - RNA, 51 nt, Artificial Sequence
  Description of Artificial Sequence: Synthetic oligonucleotide
gggaggacgaugcgguuugggguuuucccgggccccagacgacucgcccga

SEQ ID NO: 3518 - RNA, 52 nt, Artificial Sequence
  Description of Artificial Sequence: Synthetic oligonucleotide
gggaggacgaugcgguuugggguuuuucccuugccccagacgacucgcccga

SEQ ID NO: 3519 - RNA, 52 nt, Artificial Sequence
  Description of Artificial Sequence: Synthetic oligonucleotide
gggaggacgaugcgguuugggguuuuuuccgugccccagacgacucgcccga

SEQ ID NO: 3520 - RNA, 50 nt, Artificial Sequence
  Description of Artificial Sequence: Synthetic oligonucleotide
gggaggacgaugcgguuugugugggauguggccccagacgacucgcccga

SEQ ID NO: 3521 - RNA, 53 nt, Artificial Sequence
  Description of Artificial Sequence: Synthetic oligonucleotide
gggaggacgaugcggaauuauguguuuuuugugaccgcagacgacucgcccga

SEQ ID NO: 3522 - RNA, 51 nt, Artificial Sequence
  Description of Artificial Sequence: Synthetic oligonucleotide
gggaggacgaugcggcugucuaccuccuacugccgcagacgacucgcccga

SEQ ID NO: 3523 - RNA, 51 nt, Artificial Sequence
  Description of Artificial Sequence: Synthetic oligonucleotide
gggaggacgaugcggucugacgagucucccaucgccagacgacucgcccga

SEQ ID NO: 3524 - RNA, 51 nt, Artificial Sequence
  Description of Artificial Sequence: Synthetic oligonucleotide
gggaggacgaugcggaccagucgucuguucguccccagacgacucgcccga

SEQ ID NO: 3525 - RNA, 51 nt, Artificial Sequence
  Description of Artificial Sequence: Synthetic oligonucleotide
gggaggacgaugcggaccagucguuuguaccuccccagacgacucgcccga

SEQ ID NO: 3526 - RNA, 51 nt, Artificial Sequence
  Description of Artificial Sequence: Synthetic oligonucleotide
gggaggacgaugcggaccugucguauguucguacccagacgacucgcccga

SEQ ID NO: 3527 - RNA, 51 nt, Artificial Sequence
  Description of Artificial Sequence: Synthetic oligonucleotide
gggaggacgaugcggaccugucguauguucguccccagacgacucgcccga

SEQ ID NO: 3528 - RNA, 51 nt, Artificial Sequence
  Description of Artificial Sequence: Synthetic oligonucleotide
gggaggacgaugcggcagucgucuauuuucguccccagacgacucgcccga

SEQ ID NO: 3529 - RNA, 51 nt, Artificial Sequence
  Description of Artificial Sequence: Synthetic oligonucleotide
gggaggacgaugcggccacucgucugacaccuccccagacgacucgcccga

SEQ ID NO: 3530 - RNA, 51 nt, Artificial Sequence
  Description of Artificial Sequence: Synthetic oligonucleotide
gggaggacgaugcggcccguugucuguuuccgccccagacgacucgcccga

SEQ ID NO: 3531 - RNA, 51 nt, Artificial Sequence
  Description of Artificial Sequence: Synthetic oligonucleotide
gggaggacgaugcggcccugucgucaguucguccccagacgacucgcccga

SEQ ID NO: 3532 - RNA, 50 nt, Artificial Sequence
  Description of Artificial Sequence: Synthetic oligonucleotide
gggaggacgaugcggcccugucgucuuucguccccagacgacucgcccga

SEQ ID NO: 3533 - RNA, 51 nt, Artificial Sequence
  Description of Artificial Sequence: Synthetic oligonucleotide
gggaggacgaugcggcccuuucgucuguucguccccagacgacucgcccga

SEQ ID NO: 3534 - RNA, 51 nt, Artificial Sequence
  Description of Artificial Sequence: Synthetic oligonucleotide
gggaggacgaugcggccgagucucugcauucuccccagacgacucgcccga

SEQ ID NO: 3535 - RNA, 51 nt, Artificial Sequence
  Description of Artificial Sequence: Synthetic oligonucleotide
gggaggacgaugcggccgauucgucuagcccuccccagacgacucgcccga

SEQ ID NO: 3536 - RNA, 51 nt, Artificial Sequence
  Description of Artificial Sequence: Synthetic oligonucleotide
gggaggacgaugcggccguacucgucugaccuccccagacgacucgcccga

SEQ ID NO: 3537 - RNA, 49 nt, Artificial Sequence
  Description of Artificial Sequence: Synthetic oligonucleotide
gggaggacgaugcggccugucgucuguucgucccagacgacucgcccga

SEQ ID NO: 3538 - RNA, 50 nt, Artificial Sequence
  Description of Artificial Sequence: Synthetic oligonucleotide
gggaggacgaugcggccugucgucuguuuguccccagacgacucgcccga

SEQ ID NO: 3539 - RNA, 51 nt, Artificial Sequence
  Description of Artificial Sequence: Synthetic oligonucleotide
gggaggacgaugcggccuguuguucugauacuccccagacgacucgcccga

SEQ ID NO: 3540 - RNA, 51 nt, Artificial Sequence
  Description of Artificial Sequence: Synthetic oligonucleotide
gggaggacgaugcggccuugucgucugauugccgccagacgacucgcccga

SEQ ID NO: 3541 - RNA, 51 nt, Artificial Sequence
  Description of Artificial Sequence: Synthetic oligonucleotide
gggaggacgaugcggcgaauccucugcaccuuccccagacgacucgcccga

SEQ ID NO: 3542 - RNA, 51 nt, Artificial Sequence
  Description of Artificial Sequence: Synthetic oligonucleotide
gggaggacgaugcggcgacguucuguuuugcuccccagacgacucgcccga

SEQ ID NO: 3543 - RNA, 51 nt, Artificial Sequence
  Description of Artificial Sequence: Synthetic oligonucleotide
gggaggacgaugcggcgacucgcucugaaacuccccagacgacucgcccga

SEQ ID NO: 3544 - RNA, 51 nt, Artificial Sequence
  Description of Artificial Sequence: Synthetic oligonucleotide
gggaggacgaugcggcgagccucugauuucguccccagacgacucgcccga

SEQ ID NO: 3545 - RNA, 51 nt, Artificial Sequence
  Description of Artificial Sequence: Synthetic oligonucleotide
gggaggacgaugcggcgagccucugucucucuccccagacgacucgcccga

SEQ ID NO: 3546 - RNA, 51 nt, Artificial Sequence
  Description of Artificial Sequence: Synthetic oligonucleotide
gggaggacgaugcggcgagcgucauuuccgucccccagacgacucgcccga

SEQ ID NO: 3547 - RNA, 51 nt, Artificial Sequence
  Description of Artificial Sequence: Synthetic oligonucleotide
gggaggacgaugcggcgagcuucugaaguccaccccagacgacucgcccga

SEQ ID NO: 3548 - RNA, 51 nt, Artificial Sequence
  Description of Artificial Sequence: Synthetic oligonucleotide
gggaggacgaugcggcgaguuuguucuuucguccccagacgacucgcccga

SEQ ID NO: 3549 - RNA, 51 nt, Artificial Sequence
  Description of Artificial Sequence: Synthetic oligonucleotide
gggaggacgaugcggcgaucucgaucuguuccccccagacgacucgcccga

SEQ ID NO: 3550 - RNA, 51 nt, Artificial Sequence
  Description of Artificial Sequence: Synthetic oligonucleotide
gggaggacgaugcggcgaucucgucugucccuccccagacgacucgcccga

SEQ ID NO: 3551 - RNA, 51 nt, Artificial Sequence
  Description of Artificial Sequence: Synthetic oligonucleotide
gggaggacgaugcggcgauuccucuguucccuccccagacgacucgcccga

SEQ ID NO: 3552 - RNA, 51 nt, Artificial Sequence
  Description of Artificial Sequence: Synthetic oligonucleotide
gggaggacgaugcggcgauucucuguaccccuccccagacgacucgcccga

SEQ ID NO: 3553 - RNA, 51 nt, Artificial Sequence
  Description of Artificial Sequence: Synthetic oligonucleotide
gggaggacgaugcggcgcuuccgucuguuacuccccagacgacucgcccga

SEQ ID NO: 3554 - RNA, 51 nt, Artificial Sequence
  Description of Artificial Sequence: Synthetic oligonucleotide
gggaggacgaugcggcgcuucgucugucagcuccccagacgacucgcccga

SEQ ID NO: 3555 - RNA, 51 nt, Artificial Sequence
  Description of Artificial Sequence: Synthetic oligonucleotide
gggaggacgaugcggcggcgucuguuuguucuccccagacgacucgcccga

SEQ ID NO: 3556 - RNA, 51 nt, Artificial Sequence
  Description of Artificial Sequence: Synthetic oligonucleotide
gggaggacgaugcggcggucgucuccaaucguccccagacgacucgcccga

SEQ ID NO: 3557 - RNA, 51 nt, Artificial Sequence
  Description of Artificial Sequence: Synthetic oligonucleotide
gggaggacgaugcggcguaucguucuggcccuccccagacgacucgcccga

SEQ ID NO: 3558 - RNA, 51 nt, Artificial Sequence
  Description of Artificial Sequence: Synthetic oligonucleotide
gggaggacgaugcggcguguccucugcauucuccccagacgacucgcccga

SEQ ID NO: 3559 - RNA, 50 nt, Artificial Sequence
  Description of Artificial Sequence: Synthetic oligonucleotide
gggaggacgaugcggcguucucgucugacguccccagacgacucgcccga

SEQ ID NO: 3560 - RNA, 51 nt, Artificial Sequence
  Description of Artificial Sequence: Synthetic oligonucleotide
gggaggacgaugcggcguucucgucugucacuccccagacgacucgcccga

SEQ ID NO: 3561 - RNA, 51 nt, Artificial Sequence
  Description of Artificial Sequence: Synthetic oligonucleotide
gggaggacgaugcggcguuucaucugguuccuccccagacgacucgcccga

SEQ ID NO: 3562 - RNA, 51 nt, Artificial Sequence
  Description of Artificial Sequence: Synthetic oligonucleotide
gggaggacgaugcggcguuuccucugguccguccccagacgacucgcccga

SEQ ID NO: 3563 - RNA, 50 nt, Artificial Sequence
  Description of Artificial Sequence: Synthetic oligonucleotide
gggaggacgaugcggcguuuccucugguucguuccagacgacucgcccga

SEQ ID NO: 3564 - RNA, 51 nt, Artificial Sequence
  Description of Artificial Sequence: Synthetic oligonucleotide
gggaggacgaugcggcguuucguuugccucuuccccagacgacucgcccga

SEQ ID NO: 3565 - RNA, 51 nt, Artificial Sequence
  Description of Artificial Sequence: Synthetic oligonucleotide
gggaggacgaugcggcguuucuccugguucguccccagacgacucgcccga

SEQ ID NO: 3566 - RNA, 52 nt, Artificial Sequence
  Description of Artificial Sequence: Synthetic oligonucleotide
gggaggacgaugcggcguuuuccucugguucguccccagacgacucgcccga

SEQ ID NO: 3567 - RNA, 51 nt, Artificial Sequence
  Description of Artificial Sequence: Synthetic oligonucleotide
gggaggacgaugcggcguuuugucugaugccuccccagacgacucgcccga

SEQ ID NO: 3568 - RNA, 51 nt, Artificial Sequence
  Description of Artificial Sequence: Synthetic oligonucleotide
gggaggacgaugcggcucuucgucugcuugcuccccagacgacucgcccga

SEQ ID NO: 3569 - RNA, 51 nt, Artificial Sequence
  Description of Artificial Sequence: Synthetic oligonucleotide
gggaggacgaugcggcugacucgucugucccuccccagacgacucgcccga

SEQ ID NO: 3570 - RNA, 51 nt, Artificial Sequence
  Description of Artificial Sequence: Synthetic oligonucleotide
gggaggacgaugcggcugaucgucuguugccuccccagacgacucgcccga

SEQ ID NO: 3571 - RNA, 51 nt, Artificial Sequence
  Description of Artificial Sequence: Synthetic oligonucleotide
gggaggacgaugcggcuuucgucuggacucguccccagacgacucgcccga

SEQ ID NO: 3572 - RNA, 52 nt, Artificial Sequence
  Description of Artificial Sequence: Synthetic oligonucleotide
gggaggacgaugcgggaccugucgucuguucguccccagacgacucgcccga

SEQ ID NO: 3573 - RNA, 50 nt, Artificial Sequence
  Description of Artificial Sequence: Synthetic oligonucleotide
gggaggacgaugcgggacuguaugggguucugugcagacgacucgcccga

SEQ ID NO: 3574 - RNA, 51 nt, Artificial Sequence
  Description of Artificial Sequence: Synthetic oligonucleotide
gggaggacgaugcgggcacucgucugaauccuccccagacgacucgcccga

SEQ ID NO: 3575 - RNA, 51 nt, Artificial Sequence
  Description of Artificial Sequence: Synthetic oligonucleotide
gggaggacgaugcgggcacuucgucuuacccuccccagacgacucgcccga

SEQ ID NO: 3576 - RNA, 51 nt, Artificial Sequence
  Description of Artificial Sequence: Synthetic oligonucleotide
gggaggacgaugcgggccagcgucuguuuccuccccagacgacucgcccga

SEQ ID NO: 3577 - RNA, 51 nt, Artificial Sequence
  Description of Artificial Sequence: Synthetic oligonucleotide
gggaggacgaugcgggccaguucuucuguugccgccagacgacucgcccga

SEQ ID NO: 3578 - RNA, 51 nt, Artificial Sequence
  Description of Artificial Sequence: Synthetic oligonucleotide
gggaggacgaugcgggcccauucgucuaaccuccccagacgacucgcccga

SEQ ID NO: 3579 - RNA, 51 nt, Artificial Sequence
  Description of Artificial Sequence: Synthetic oligonucleotide
gggaggacgaugcgggcccuucgaucuguuguccccagacgacucgcccga

SEQ ID NO: 3580 - RNA, 51 nt, Artificial Sequence
  Description of Artificial Sequence: Synthetic oligonucleotide
gggaggacgaugcgggccucgucuguuuuacuccccagacgacucgcccga

SEQ ID NO: 3581 - RNA, 51 nt, Artificial Sequence
  Description of Artificial Sequence: Synthetic oligonucleotide
gggaggacgaugcgggccucucgucuacgguccuccagacgacucgcccga

SEQ ID NO: 3582 - RNA, 51 nt, Artificial Sequence
  Description of Artificial Sequence: Synthetic oligonucleotide
gggaggacgaugcgggccucucgucugcuccuccccagacgacucgcccga

SEQ ID NO: 3583 - RNA, 51 nt, Artificial Sequence
  Description of Artificial Sequence: Synthetic oligonucleotide
gggaggacgaugcgggccucucgucuguuccgccccagacgacucgcccga

SEQ ID NO: 3584 - RNA, 51 nt, Artificial Sequence
  Description of Artificial Sequence: Synthetic oligonucleotide
gggaggacgaugcgggccuucucgucugucguccccagacgacucgcccga

SEQ ID NO: 3585 - RNA, 51 nt, Artificial Sequence
  Description of Artificial Sequence: Synthetic oligonucleotide
gggaggacgaugcgggccuucucgucugucugccccagacgacucgcccga

SEQ ID NO: 3586 - RNA, 51 nt, Artificial Sequence
  Description of Artificial Sequence: Synthetic oligonucleotide
gggaggacgaugcgggccuucucgucuguuguccacagacgacucgcccga

SEQ ID NO: 3587 - RNA, 53 nt, Artificial Sequence
  Description of Artificial Sequence: Synthetic oligonucleotide
gggaggacgaugcgggccuucucgucuguugucuucccagacgacucgcccga

SEQ ID NO: 3588 - RNA, 51 nt, Artificial Sequence
  Description of Artificial Sequence: Synthetic oligonucleotide
gggaggacgaugcgggccuuucguuaugaccuccccagacgacucgcccga

SEQ ID NO: 3589 - RNA, 51 nt, Artificial Sequence
  Description of Artificial Sequence: Synthetic oligonucleotide
gggaggacgaugcgggccuuucguuccgaccuccccagacgacucgcccga

SEQ ID NO: 3590 - RNA, 51 nt, Artificial Sequence
  Description of Artificial Sequence: Synthetic oligonucleotide
gggaggacgaugcgggccuuucguucugcccuccccagacgacucgcccga

SEQ ID NO: 3591 - RNA, 51 nt, Artificial Sequence
  Description of Artificial Sequence: Synthetic oligonucleotide
gggaggacgaugcgggcgauuccucuguucguccccagacgacucgcccga

SEQ ID NO: 3592 - RNA, 51 nt, Artificial Sequence
  Description of Artificial Sequence: Synthetic oligonucleotide
gggaggacgaugcgggcguuuccccuguucguccccagacgacucgcccga

SEQ ID NO: 3593 - RNA, 51 nt, Artificial Sequence
  Description of Artificial Sequence: Synthetic oligonucleotide
gggaggacgaugcgggcguuuccuccguucguccccagacgacucgcccga

SEQ ID NO: 3594 - RNA, 51 nt, Artificial Sequence
  Description of Artificial Sequence: Synthetic oligonucleotide
gggaggacgaugcgggcguuuccucuguucauccccagacgacucgcccga

SEQ ID NO: 3595 - RNA, 51 nt, Artificial Sequence
  Description of Artificial Sequence: Synthetic oligonucleotide
gggaggacgaugcgggcguuuccucuguucgcccccagacgacucgcccga

SEQ ID NO: 3596 - RNA, 51 nt, Artificial Sequence
  Description of Artificial Sequence: Synthetic oligonucleotide
gggaggacgaugcgggcguuuccucuguugguccccagacgacucgcccga

SEQ ID NO: 3597 - RNA, 51 nt, Artificial Sequence
  Description of Artificial Sequence: Synthetic oligonucleotide
gggaggacgaugcgggcuaacucgucuagccuccccagacgacucgcccga

SEQ ID NO: 3598 - RNA, 51 nt, Artificial Sequence
  Description of Artificial Sequence: Synthetic oligonucleotide
gggaggacgaugcgggcucucucgucuuacguccccagacgacucgcccga

SEQ ID NO: 3599 - RNA, 51 nt, Artificial Sequence
  Description of Artificial Sequence: Synthetic oligonucleotide
gggaggacgaugcgggcuuucgaucuguucguccccagacgacucgcccga

SEQ ID NO: 3600 - RNA, 51 nt, Artificial Sequence
  Description of Artificial Sequence: Synthetic oligonucleotide
gggaggacgaugcgggcuuucuucuggugccuccccagacgacucgcccga

SEQ ID NO: 3601 - RNA, 51 nt, Artificial Sequence
  Description of Artificial Sequence: Synthetic oligonucleotide
gggaggacgaugcggggugucguucugucccuccccagacgacucgcccga

SEQ ID NO: 3602 - RNA, 51 nt, Artificial Sequence
  Description of Artificial Sequence: Synthetic oligonucleotide
gggaggacgaugcggguacucucgucugcgcuccccagacgacucgcccga

SEQ ID NO: 3603 - RNA, 48 nt, Artificial Sequence
  Description of Artificial Sequence: Synthetic oligonucleotide
gggaggacgaugcggguccugucgucuguucccagacgacucgcccga

SEQ ID NO: 3604 - RNA, 51 nt, Artificial Sequence
  Description of Artificial Sequence: Synthetic oligonucleotide
gggaggacgaugcggguccugucgucuuacguucccagacgacucgcccga

SEQ ID NO: 3605 - RNA, 51 nt, Artificial Sequence
  Description of Artificial Sequence: Synthetic oligonucleotide
gggaggacgaugcggguccugucgucuuacguuuccagacgacucgcccga

SEQ ID NO: 3606 - RNA, 51 nt, Artificial Sequence
  Description of Artificial Sequence: Synthetic oligonucleotide
gggaggacgaugcggguccugucgucuuguccccccagacgacucgcccga

SEQ ID NO: 3607 - RNA, 51 nt, Artificial Sequence
  Description of Artificial Sequence: Synthetic oligonucleotide
gggaggacgaugcgggugagcuucugcugucuccccagacgacucgcccga

SEQ ID NO: 3608 - RNA, 51 nt, Artificial Sequence
  Description of Artificial Sequence: Synthetic oligonucleotide
gggaggacgaugcgggugauccucugguucguccccagacgacucgcccga

SEQ ID NO: 3609 - RNA, 51 nt, Artificial Sequence
  Description of Artificial Sequence: Synthetic oligonucleotide
gggaggacgaugcgggugguucucugguucguccccagacgacucgcccga

SEQ ID NO: 3610 - RNA, 51 nt, Artificial Sequence
  Description of Artificial Sequence: Synthetic oligonucleotide
gggaggacgaugcgguaaugucgucuguuaguccccagacgacucgcccga

SEQ ID NO: 3611 - RNA, 51 nt, Artificial Sequence
  Description of Artificial Sequence: Synthetic oligonucleotide
gggaggacgaugcgguaaugucgucuguucguacccagacgacucgcccga

SEQ ID NO: 3612 - RNA, 51 nt, Artificial Sequence
  Description of Artificial Sequence: Synthetic oligonucleotide
gggaggacgaugcgguacugucgucuguuagucaccagacgacucgcccga

SEQ ID NO: 3613 - RNA, 51 nt, Artificial Sequence
  Description of Artificial Sequence: Synthetic oligonucleotide
gggaggacgaugcgguacugucgucuguucguaaccagacgacucgcccga

SEQ ID NO: 3614 - RNA, 51 nt, Artificial Sequence
  Description of Artificial Sequence: Synthetic oligonucleotide
gggaggacgaugcggucacgucgucuguucguccccagacgacucgcccga

SEQ ID NO: 3615 - RNA, 51 nt, Artificial Sequence
  Description of Artificial Sequence: Synthetic oligonucleotide
gggaggacgaugcggucauggcuugucguuguccccagacgacucgcccga

SEQ ID NO: 3616 - RNA, 51 nt, Artificial Sequence
  Description of Artificial Sequence: Synthetic oligonucleotide
gggaggacgaugcggucauguaguauguucguacccagacgacucgcccga

SEQ ID NO: 3617 - RNA, 51 nt, Artificial Sequence
  Description of Artificial Sequence: Synthetic oligonucleotide
gggaggacgaugcggucaugucguauguuaguccccagacgacucgcccga

SEQ ID NO: 3618 - RNA, 51 nt, Artificial Sequence
  Description of Artificial Sequence: Synthetic oligonucleotide
gggaggacgaugcggucaugucgucuguuaguacacagacgacucgcccga

SEQ ID NO: 3619 - RNA, 51 nt, Artificial Sequence
  Description of Artificial Sequence: Synthetic oligonucleotide
gggaggacgaugcggucaugucguuuguucguccccagacgacucgcccga

SEQ ID NO: 3620 - RNA, 51 nt, Artificial Sequence
  Description of Artificial Sequence: Synthetic oligonucleotide
gggaggacgaugcgguccagucgucucuucguccccagacgacucgcccga

SEQ ID NO: 3621 - RNA, 51 nt, Artificial Sequence
  Description of Artificial Sequence: Synthetic oligonucleotide
gggaggacgaugcgguccagucgucuguucguacacagacgacucgcccga

SEQ ID NO: 3622 - RNA, 51 nt, Artificial Sequence
  Description of Artificial Sequence: Synthetic oligonucleotide
gggaggacgaugcgguccccucgucuguucguccccagacgacucgcccga

SEQ ID NO: 3623 - RNA, 50 nt, Artificial Sequence
  Description of Artificial Sequence: Synthetic oligonucleotide
gggaggacgaugcggucccgucgucugucguccccagacgacucgcccga

SEQ ID NO: 3624 - RNA, 51 nt, Artificial Sequence
  Description of Artificial Sequence: Synthetic oligonucleotide
gggaggacgaugcggucccgucgucuguucgucuccagacgacucgcccga

SEQ ID NO: 3625 - RNA, 51 nt, Artificial Sequence
  Description of Artificial Sequence: Synthetic oligonucleotide
gggaggacgaugcggucccgucgucuguucuuccccagacgacucgcccga

SEQ ID NO: 3626 - RNA, 51 nt, Artificial Sequence
  Description of Artificial Sequence: Synthetic oligonucleotide
gggaggacgaugcgguccuaucgucuguucguucccagacgacucgcccga

SEQ ID NO: 3627 - RNA, 51 nt, Artificial Sequence
  Description of Artificial Sequence: Synthetic oligonucleotide
gggaggacgaugcgguccucucgucuguuccuccccagacgacucgcccga

SEQ ID NO: 3628 - RNA, 51 nt, Artificial Sequence
  Description of Artificial Sequence: Synthetic oligonucleotide
gggaggacgaugcgguccugccgucuguuccuccccagacgacucgcccga

SEQ ID NO: 3629 - RNA, 51 nt, Artificial Sequence
  Description of Artificial Sequence: Synthetic oligonucleotide
gggaggacgaugcgguccugccgucuguucgucuccagacgacucgcccga

SEQ ID NO: 3630 - RNA, 51 nt, Artificial Sequence
  Description of Artificial Sequence: Synthetic oligonucleotide
gggaggacgaugcgguccugccgucuguucguuuccagacgacucgcccga

SEQ ID NO: 3631 - RNA, 51 nt, Artificial Sequence
  Description of Artificial Sequence: Synthetic oligonucleotide
gggaggacgaugcgguccuggcgucuggucguccccagacgacucgcccga

SEQ ID NO: 3632 - RNA, 51 nt, Artificial Sequence
  Description of Artificial Sequence: Synthetic oligonucleotide
gggaggacgaugcgguccuggcuugucgguguccccagacgacucgcccga

SEQ ID NO: 3633 - RNA, 50 nt, Artificial Sequence
  Description of Artificial Sequence: Synthetic oligonucleotide
gggaggacgaugcgguccuggcuugucguugccccagacgacucgcccga

SEQ ID NO: 3634 - RNA, 52 nt, Artificial Sequence
  Description of Artificial Sequence: Synthetic oligonucleotide
gggaggacgaugcgguccuggcuugucguugucccccagacgacucgcccga

SEQ ID NO: 3635 - RNA, 51 nt, Artificial Sequence
  Description of Artificial Sequence: Synthetic oligonucleotide
gggaggacgaugcgguccuggcuugucguuguccgcagacgacucgcccga

SEQ ID NO: 3636 - RNA, 51 nt, Artificial Sequence
  Description of Artificial Sequence: Synthetic oligonucleotide
gggaggacgaugcgguccuggcuugucguugucgccagacgacucgcccga

SEQ ID NO: 3637 - RNA, 51 nt, Artificial Sequence
  Description of Artificial Sequence: Synthetic oligonucleotide
gggaggacgaugcgguccuggcuugucuuuguccccagacgacucgcccga

SEQ ID NO: 3638 - RNA, 51 nt, Artificial Sequence
  Description of Artificial Sequence: Synthetic oligonucleotide
gggaggacgaugcgguccuggcuuuucguuguccccagacgacucgcccga

SEQ ID NO: 3639 - RNA, 51 nt, Artificial Sequence
  Description of Artificial Sequence: Synthetic oligonucleotide
gggaggacgaugcgguccuguaguauguucguacccagacgacucgcccga

SEQ ID NO: 3640 - RNA, 51 nt, Artificial Sequence
  Description of Artificial Sequence: Synthetic oligonucleotide
gggaggacgaugcgguccuguaguauguucguccacagacgacucgcccga

SEQ ID NO: 3641 - RNA, 51 nt, Artificial Sequence
  Description of Artificial Sequence: Synthetic oligonucleotide
gggaggacgaugcgguccuguagucugaucguccccagacgacucgcccga

SEQ ID NO: 3642 - RNA, 51 nt, Artificial Sequence
  Description of Artificial Sequence: Synthetic oligonucleotide
gggaggacgaugcgguccuguagucuguucgaccccagacgacucgcccga

SEQ ID NO: 3643 - RNA, 51 nt, Artificial Sequence
  Description of Artificial Sequence: Synthetic oligonucleotide
gggaggacgaugcgguccuguaguuuguucguccccagacgacucgcccga

SEQ ID NO: 3644 - RNA, 50 nt, Artificial Sequence
  Description of Artificial Sequence: Synthetic oligonucleotide
gggaggacgaugcgguccugucaucuguucgucccagacgacucgcccga

SEQ ID NO: 3645 - RNA, 51 nt, Artificial Sequence
  Description of Artificial Sequence: Synthetic oligonucleotide
gggaggacgaugcgguccugucgcuuguucguccccagacgacucgcccga

SEQ ID NO: 3646 - RNA, 51 nt, Artificial Sequence
  Description of Artificial Sequence: Synthetic oligonucleotide
gggaggacgaugcgguccugucguauguucgaccccagacgacucgcccga

SEQ ID NO: 3647 - RNA, 51 nt, Artificial Sequence
  Description of Artificial Sequence: Synthetic oligonucleotide
gggaggacgaugcgguccugucguccgucuguccccagacgacucgcccga

SEQ ID NO: 3648 - RNA, 51 nt, Artificial Sequence
  Description of Artificial Sequence: Synthetic oligonucleotide
gggaggacgaugcgguccugucguccguuccuccccagacgacucgcccga

SEQ ID NO: 3649 - RNA, 51 nt, Artificial Sequence
  Description of Artificial Sequence: Synthetic oligonucleotide
gggaggacgaugcgguccugucguccguucguacccagacgacucgcccga

SEQ ID NO: 3650 - RNA, 50 nt, Artificial Sequence
  Description of Artificial Sequence: Synthetic oligonucleotide
gggaggacgaugcgguccugucgucuauucgucccagacgacucgcccga

SEQ ID NO: 3651 - RNA, 51 nt, Artificial Sequence
  Description of Artificial Sequence: Synthetic oligonucleotide
gggaggacgaugcgguccugucgucucuucgcccccagacgacucgcccga

SEQ ID NO: 3652 - RNA, 51 nt, Artificial Sequence
  Description of Artificial Sequence: Synthetic oligonucleotide
gggaggacgaugcgguccugucgucucuucguuuccagacgacucgcccga

SEQ ID NO: 3653 - RNA, 50 nt, Artificial Sequence
  Description of Artificial Sequence: Synthetic oligonucleotide
gggaggacgaugcgguccugucgucugcacuccccagacgacucgcccga

SEQ ID NO: 3654 - RNA, 48 nt, Artificial Sequence
  Description of Artificial Sequence: Synthetic oligonucleotide
gggaggacgaugcgguccugucgucugcuccccagacgacucgcccga

SEQ ID NO: 3655 - RNA, 51 nt, Artificial Sequence
  Description of Artificial Sequence: Synthetic oligonucleotide
gggaggacgaugcgguccugucgucuguaaguccccagacgacucgcccga

SEQ ID NO: 3656 - RNA, 51 nt, Artificial Sequence
  Description of Artificial Sequence: Synthetic oligonucleotide
gggaggacgaugcgguccugucgucuguacgucaccagacgacucgcccga

SEQ ID NO: 3657 - RNA, 50 nt, Artificial Sequence
  Description of Artificial Sequence: Synthetic oligonucleotide
gggaggacgaugcgguccugucgucuguccgucccagacgacucgcccga

SEQ ID NO: 3658 - RNA, 49 nt, Artificial Sequence
  Description of Artificial Sequence: Synthetic oligonucleotide
gggaggacgaugcgguccugucgucugucgucccagacgacucgcccga

SEQ ID NO: 3659 - RNA, 51 nt, Artificial Sequence
  Description of Artificial Sequence: Synthetic oligonucleotide
gggaggacgaugcgguccugucgucuguuacuccccagacgacucgcccga

SEQ ID NO: 3660 - RNA, 51 nt, Artificial Sequence
  Description of Artificial Sequence: Synthetic oligonucleotide
gggaggacgaugcgguccugucgucuguuagucaacagacgacucgcccga

SEQ ID NO: 3661 - RNA, 51 nt, Artificial Sequence
  Description of Artificial Sequence: Synthetic oligonucleotide
gggaggacgaugcgguccugucgucuguucaucaccagacgacucgcccga

SEQ ID NO: 3662 - RNA, 51 nt, Artificial Sequence
  Description of Artificial Sequence: Synthetic oligonucleotide
gggaggacgaugcgguccugucgucuguucauuuccagacgacucgcccga

SEQ ID NO: 3663 - RNA, 50 nt, Artificial Sequence
  Description of Artificial Sequence: Synthetic oligonucleotide
gggaggacgaugcgguccugucgucuguucgacccagacgacucgcccga

SEQ ID NO: 3664 - RNA, 51 nt, Artificial Sequence
  Description of Artificial Sequence: Synthetic oligonucleotide
gggaggacgaugcgguccugucgucuguucgaucccagacgacucgcccga

SEQ ID NO: 3665 - RNA, 52 nt, Artificial Sequence
  Description of Artificial Sequence: Synthetic oligonucleotide
gggaggacgaugcgguccugucgucuguucguaccccagacgacucgcccga

SEQ ID NO: 3666 - RNA, 52 nt, Artificial Sequence
  Description of Artificial Sequence: Synthetic oligonucleotide
gggaggacgaugcgguccugucgucuguucgucccucagacgacucgcccga

SEQ ID NO: 3667 - RNA, 52 nt, Artificial Sequence
  Description of Artificial Sequence: Synthetic oligonucleotide
gggaggacgaugcgguccugucgucuguucguccuccagacgacucgcccga

SEQ ID NO: 3668 - RNA, 51 nt, Artificial Sequence
  Description of Artificial Sequence: Synthetic oligonucleotide
gggaggacgaugcgguccugucgucuguucguucgcagacgacucgcccga

SEQ ID NO: 3669 - RNA, 51 nt, Artificial Sequence
  Description of Artificial Sequence: Synthetic oligonucleotide
gggaggacgaugcgguccugucgucuguucguucucagacgacucgcccga

SEQ ID NO: 3670 - RNA, 51 nt, Artificial Sequence
  Description of Artificial Sequence: Synthetic oligonucleotide
gggaggacgaugcgguccugucgucuguucuguuccagacgacucgcccga

SEQ ID NO: 3671 - RNA, 51 nt, Artificial Sequence
  Description of Artificial Sequence: Synthetic oligonucleotide
gggaggacgaugcgguccugucgucuguucuuacccagacgacucgcccga

SEQ ID NO: 3672 - RNA, 51 nt, Artificial Sequence
  Description of Artificial Sequence: Synthetic oligonucleotide
gggaggacgaugcgguccugucgucuguucuucaccagacgacucgcccga

SEQ ID NO: 3673 - RNA, 51 nt, Artificial Sequence
  Description of Artificial Sequence: Synthetic oligonucleotide
gggaggacgaugcgguccugucgucuguucuuccacagacgacucgcccga

SEQ ID NO: 3674 - RNA, 51 nt, Artificial Sequence
  Description of Artificial Sequence: Synthetic oligonucleotide
gggaggacgaugcgguccugucgucuguugcuccccagacgacucgcccga

SEQ ID NO: 3675 - RNA, 51 nt, Artificial Sequence
  Description of Artificial Sequence: Synthetic oligonucleotide
gggaggacgaugcgguccugucgucuguuuguuuccagacgacucgcccga

SEQ ID NO: 3676 - RNA, 51 nt, Artificial Sequence
  Description of Artificial Sequence: Synthetic oligonucleotide
gggaggacgaugcgguccugucgucuuuuccuccccagacgacucgcccga

SEQ ID NO: 3677 - RNA, 51 nt, Artificial Sequence
  Description of Artificial Sequence: Synthetic oligonucleotide
gggaggacgaugcgguccugucgucuuuucgucuccagacgacucgcccga

SEQ ID NO: 3678 - RNA, 51 nt, Artificial Sequence
  Description of Artificial Sequence: Synthetic oligonucleotide
gggaggacgaugcgguccugucgucuuuuuguccccagacgacucgcccga

SEQ ID NO: 3679 - RNA, 51 nt, Artificial Sequence
  Description of Artificial Sequence: Synthetic oligonucleotide
gggaggacgaugcgguccugucguuugcucguccccagacgacucgcccga

SEQ ID NO: 3680 - RNA, 51 nt, Artificial Sequence
  Description of Artificial Sequence: Synthetic oligonucleotide
gggaggacgaugcgguccugucguuuguucguccacagacgacucgcccga

SEQ ID NO: 3681 - RNA, 51 nt, Artificial Sequence
  Description of Artificial Sequence: Synthetic oligonucleotide
gggaggacgaugcgguccugucguuuguucguuuccagacgacucgcccga

SEQ ID NO: 3682 - RNA, 51 nt, Artificial Sequence
  Description of Artificial Sequence: Synthetic oligonucleotide
gggaggacgaugcgguccugucguuuguucuuccccagacgacucgcccga

SEQ ID NO: 3683 - RNA, 51 nt, Artificial Sequence
  Description of Artificial Sequence: Synthetic oligonucleotide
gggaggacgaugcgguccugucguuuguugguccccagacgacucgcccga

SEQ ID NO: 3684 - RNA, 51 nt, Artificial Sequence
  Description of Artificial Sequence: Synthetic oligonucleotide
gggaggacgaugcgguccugucguuuuuucguccccagacgacucgcccga

SEQ ID NO: 3685 - RNA, 51 nt, Artificial Sequence
  Description of Artificial Sequence: Synthetic oligonucleotide
gggaggacgaugcgguccuguugucuguucgucaccagacgacucgcccga

SEQ ID NO: 3686 - RNA, 51 nt, Artificial Sequence
  Description of Artificial Sequence: Synthetic oligonucleotide
gggaggacgaugcgguccuuucgucuguucgucuccagacgacucgcccga

SEQ ID NO: 3687 - RNA, 51 nt, Artificial Sequence
  Description of Artificial Sequence: Synthetic oligonucleotide
gggaggacgaugcgguccuuucuucuguucguccccagacgacucgcccga

SEQ ID NO: 3688 - RNA, 51 nt, Artificial Sequence
  Description of Artificial Sequence: Synthetic oligonucleotide
gggaggacgaugcggucgacgucuguugguccccccagacgacucgcccga

SEQ ID NO: 3689 - RNA, 51 nt, Artificial Sequence
  Description of Artificial Sequence: Synthetic oligonucleotide
gggaggacgaugcggucgaucugguauucccccgccagacgacucgcccga

SEQ ID NO: 3690 - RNA, 51 nt, Artificial Sequence
  Description of Artificial Sequence: Synthetic oligonucleotide
gggaggacgaugcggucgcugucgucuugccuccccagacgacucgcccga

SEQ ID NO: 3691 - RNA, 51 nt, Artificial Sequence
  Description of Artificial Sequence: Synthetic oligonucleotide
gggaggacgaugcggucucucuggguuugccgccccagacgacucgcccga

SEQ ID NO: 3692 - RNA, 50 nt, Artificial Sequence
  Description of Artificial Sequence: Synthetic oligonucleotide
gggaggacgaugcggucugucgucuguucguucccagacgacucgcccga

SEQ ID NO: 3693 - RNA, 50 nt, Artificial Sequence
  Description of Artificial Sequence: Synthetic oligonucleotide
gggaggacgaugcggucugugugggaugugcccccagacgacucgcccga

SEQ ID NO: 3694 - RNA, 52 nt, Artificial Sequence
  Description of Artificial Sequence: Synthetic oligonucleotide
gggaggacgaugcggucuguugcgcuugauaugccccagacgacucgcccga

SEQ ID NO: 3695 - RNA, 51 nt, Artificial Sequence
  Description of Artificial Sequence: Synthetic oligonucleotide
gggaggacgaugcggucuucuggcuuuucccuggccagacgacucgcccga

SEQ ID NO: 3696 - RNA, 51 nt, Artificial Sequence
  Description of Artificial Sequence: Synthetic oligonucleotide
gggaggacgaugcggucuucuggguuuugccgccccagacgacucgcccga

SEQ ID NO: 3697 - RNA, 51 nt, Artificial Sequence
  Description of Artificial Sequence: Synthetic oligonucleotide
gggaggacgaugcggucuugucgucuacucguccccagacgacucgcccga

SEQ ID NO: 3698 - RNA, 51 nt, Artificial Sequence
  Description of Artificial Sequence: Synthetic oligonucleotide
gggaggacgaugcggucuugucuucuguucguccccagacgacucgcccga

SEQ ID NO: 3699 - RNA, 51 nt, Artificial Sequence
  Description of Artificial Sequence: Synthetic oligonucleotide
gggaggacgaugcggugacucguucugacccuccccagacgacucgcccga

SEQ ID NO: 3700 - RNA, 51 nt, Artificial Sequence
  Description of Artificial Sequence: Synthetic oligonucleotide
gggaggacgaugcggugagucgugucgggccgcuacagacgacucgcccga

SEQ ID NO: 3701 - RNA, 51 nt, Artificial Sequence
  Description of Artificial Sequence: Synthetic oligonucleotide
gggaggacgaugcggugagucguucccuucguacccagacgacucgcccga

SEQ ID NO: 3702 - RNA, 51 nt, Artificial Sequence
  Description of Artificial Sequence: Synthetic oligonucleotide
gggaggacgaugcggugagucuucuguuccguccccagacgacucgcccga

SEQ ID NO: 3703 - RNA, 51 nt, Artificial Sequence
  Description of Artificial Sequence: Synthetic oligonucleotide
gggaggacgaugcggugaguucucuguacccuccccagacgacucgcccga

SEQ ID NO: 3704 - RNA, 51 nt, Artificial Sequence
  Description of Artificial Sequence: Synthetic oligonucleotide
gggaggacgaugcggugaguuguccuuguggccgccagacgacucgcccga

SEQ ID NO: 3705 - RNA, 51 nt, Artificial Sequence
  Description of Artificial Sequence: Synthetic oligonucleotide
gggaggacgaugcggugcgagcuucuggaccuccccagacgacucgcccga

SEQ ID NO: 3706 - RNA, 51 nt, Artificial Sequence
  Description of Artificial Sequence: Synthetic oligonucleotide
gggaggacgaugcggugcuauucgucuguacuccccagacgacucgcccga

SEQ ID NO: 3707 - RNA, 51 nt, Artificial Sequence
  Description of Artificial Sequence: Synthetic oligonucleotide
gggaggacgaugcggugcuggcuugucguuguccccagacgacucgcccga

SEQ ID NO: 3708 - RNA, 51 nt, Artificial Sequence
  Description of Artificial Sequence: Synthetic oligonucleotide
gggaggacgaugcgguguaguuguuugugggccgccagacgacucgcccga

SEQ ID NO: 3709 - RNA, 51 nt, Artificial Sequence
  Description of Artificial Sequence: Synthetic oligonucleotide
gggaggacgaugcgguuccgagucucuguugccgccagacgacucgcccga

SEQ ID NO: 3710 - RNA, 52 nt, Artificial Sequence
  Description of Artificial Sequence: Synthetic oligonucleotide
gggaggacgaugcgguucgggguuuuucccgugccccagacgacucgcccga

SEQ ID NO: 3711 - RNA, 51 nt, Artificial Sequence
  Description of Artificial Sequence: Synthetic oligonucleotide
gggaggacgaugcgguucugucgucuguucguucccagacgacucgcccga

SEQ ID NO: 3712 - RNA, 52 nt, Artificial Sequence
  Description of Artificial Sequence: Synthetic oligonucleotide
gggaggacgaugcgguugggguuuuuucccgugccccagacgacucgcccga

SEQ ID NO: 3713 - RNA, 51 nt, Artificial Sequence
  Description of Artificial Sequence: Synthetic oligonucleotide
gggaggacgaugcgguuugagguuuucccgugccccagacgacucgcccga

SEQ ID NO: 3714 - RNA, 51 nt, Artificial Sequence
  Description of Artificial Sequence: Synthetic oligonucleotide
gggaggacgaugcgguuugggguuuucccgugcggcagacgacucgcccga

SEQ ID NO: 3715 - RNA, 51 nt, Artificial Sequence
  Description of Artificial Sequence: Synthetic oligonucleotide
gggaggacgaugcgguuugggguuuuccuccgccccagacgacucgcccga

SEQ ID NO: 3716 - RNA, 52 nt, Artificial Sequence
  Description of Artificial Sequence: Synthetic oligonucleotide
gggaggacgaugcgguuugggguuuuucccgcgccccagacgacucgcccga

SEQ ID NO: 3717 - RNA, 50 nt, Artificial Sequence
  Description of Artificial Sequence: Synthetic oligonucleotide
gggaggacgaugcgguuuggguuuucccgugccccagacgacucgcccga

SEQ ID NO: 3718 - RNA, 51 nt, Artificial Sequence
  Description of Artificial Sequence: Synthetic oligonucleotide
gggaggacgaugcggaccugucgucuguuaguccccagacgacucgcccga

SEQ ID NO: 3719 - RNA, 51 nt, Artificial Sequence
  Description of Artificial Sequence: Synthetic oligonucleotide
gggaggacgaugcggucguauuauccgcugcacgccagacgacucgcccga

SEQ ID NO: 3720 - RNA, 51 nt, Artificial Sequence
  Description of Artificial Sequence: Synthetic oligonucleotide
gggaggacgaugcggucuguacauuccugccugugcagacgacucgcccga

SEQ ID NO: 3721 - RNA, 52 nt, Artificial Sequence
  Description of Artificial Sequence: Synthetic oligonucleotide
gggaggacgaugcggucuguugugcuugauaugcuccagacgacucgcccga

SEQ ID NO: 3722 - RNA, 51 nt, Artificial Sequence
  Description of Artificial Sequence: Synthetic oligonucleotide
gggaggacgaugcgguuugcgguuuucccgugccccagacgacucgcccga

SEQ ID NO: 3723 - RNA, 51 nt, Artificial Sequence
  Description of Artificial Sequence: Synthetic oligonucleotide
gggaggacgaugcgguuuggaguuuucccgugccccagacgacucgcccga

SEQ ID NO: 3724 - RNA, 51 nt, Artificial Sequence
  Description of Artificial Sequence: Synthetic oligonucleotide
gggaggacgaugcgguuugggguuuacccgugccccagacgacucgcccga

SEQ ID NO: 3725 - RNA, 51 nt, Artificial Sequence
  Description of Artificial Sequence: Synthetic oligonucleotide
gggaggacgaugcgguuugggguuucuuccugccccagacgacucgcccga

SEQ ID NO: 3726 - RNA, 51 nt, Artificial Sequence
  Description of Artificial Sequence: Synthetic oligonucleotide
gggaggacgaugcgguuugggguuuucgcgugccccagacgacucgcccga

SEQ ID NO: 3727 - RNA, 52 nt, Artificial Sequence
  Description of Artificial Sequence: Synthetic oligonucleotide
gggaggacgaugcgguuugggguuuuucccaugccccagacgacucgcccga

SEQ ID NO: 3728 - RNA, 51 nt, Artificial Sequence
  Description of Artificial Sequence: Synthetic oligonucleotide
gggaggacgaugcggcuucacacauucccggugugcagacgacucgcccga

SEQ ID NO: 3729 - RNA, 50 nt, Artificial Sequence
  Description of Artificial Sequence: Synthetic oligonucleotide
gggaggacgaugcgggacuguauggggcuuugugcagacgacucgcccga

SEQ ID NO: 3730 - RNA, 52 nt, Artificial Sequence
  Description of Artificial Sequence: Synthetic oligonucleotide
gggaggacgaugcggucuguugugcuugaugugccccagacgacucgcccga

SEQ ID NO: 3731 - RNA, 50 nt, Artificial Sequence
  Description of Artificial Sequence: Synthetic oligonucleotide
gggaggacgaugcgguuuggggucucccgugccccagacgacucgcccga

SEQ ID NO: 3732 - RNA, 51 nt, Artificial Sequence
  Description of Artificial Sequence: Synthetic oligonucleotide
gggaggacgaugcgguuugggguuuucccguggcccagacgacucgcccga

SEQ ID NO: 3733 - RNA, 51 nt, Artificial Sequence
  Description of Artificial Sequence: Synthetic oligonucleotide
gggaggacgaugcggacaugucgucuguucguccccagacgacucgcccga

SEQ ID NO: 3734 - RNA, 51 nt, Artificial Sequence
  Description of Artificial Sequence: Synthetic oligonucleotide
gggaggacgaugcggaccugucgucuguuaguacacagacgacucgcccga

SEQ ID NO: 3735 - RNA, 51 nt, Artificial Sequence
  Description of Artificial Sequence: Synthetic oligonucleotide
gggaggacgaugcggaccugucgucuguuaguccacagacgacucgcccga

SEQ ID NO: 3736 - RNA, 51 nt, Artificial Sequence
  Description of Artificial Sequence: Synthetic oligonucleotide
gggaggacgaugcggacggguccucugcuacuccccagacgacucgcccga

SEQ ID NO: 3737 - RNA, 51 nt, Artificial Sequence
  Description of Artificial Sequence: Synthetic oligonucleotide
gggaggacgaugcggcagagucguucccucguccccagacgacucgcccga

SEQ ID NO: 3738 - RNA, 51 nt, Artificial Sequence
  Description of Artificial Sequence: Synthetic oligonucleotide
gggaggacgaugcggcagucgcucugcacucuccccagacgacucgcccga

SEQ ID NO: 3739 - RNA, 51 nt, Artificial Sequence
  Description of Artificial Sequence: Synthetic oligonucleotide
gggaggacgaugcggcaucguuucgucuguggcgccagacgacucgcccga

SEQ ID NO: 3740 - RNA, 51 nt, Artificial Sequence
  Description of Artificial Sequence: Synthetic oligonucleotide
gggaggacgaugcggcauuuccucugguucguccccagacgacucgcccga

SEQ ID NO: 3741 - RNA, 51 nt, Artificial Sequence
  Description of Artificial Sequence: Synthetic oligonucleotide
gggaggacgaugcggccagucagucugccacuccccagacgacucgcccga

SEQ ID NO: 3742 - RNA, 51 nt, Artificial Sequence
  Description of Artificial Sequence: Synthetic oligonucleotide
gggaggacgaugcggccagucgucaaucacguccccagacgacucgcccga

SEQ ID NO: 3743 - RNA, 51 nt, Artificial Sequence
  Description of Artificial Sequence: Synthetic oligonucleotide
gggaggacgaugcggccagucgucucuugcguccccagacgacucgcccga

SEQ ID NO: 3744 - RNA, 51 nt, Artificial Sequence
  Description of Artificial Sequence: Synthetic oligonucleotide
gggaggacgaugcggccagucguucuuucccuccccagacgacucgcccga

SEQ ID NO: 3745 - RNA, 51 nt, Artificial Sequence
  Description of Artificial Sequence: Synthetic oligonucleotide
gggaggacgaugcggccagucugucugagccuccccagacgacucgcccga

SEQ ID NO: 3746 - RNA, 51 nt, Artificial Sequence
  Description of Artificial Sequence: Synthetic oligonucleotide
gggaggacgaugcggcccggucgucuguucguccccagacgacucgcccga

SEQ ID NO: 3747 - RNA, 51 nt, Artificial Sequence
  Description of Artificial Sequence: Synthetic oligonucleotide
gggaggacgaugcggcccguugucugaucucuccccagacgacucgcccga

SEQ ID NO: 3748 - RNA, 49 nt, Artificial Sequence
  Description of Artificial Sequence: Synthetic oligonucleotide
gggaggacgaugcggcccugucgucuguucguccagacgacucgcccga

SEQ ID NO: 3749 - RNA, 51 nt, Artificial Sequence
  Description of Artificial Sequence: Synthetic oligonucleotide
gggaggacgaugcggcccugucgucuguucguccgcagacgacucgcccga

SEQ ID NO: 3750 - RNA, 48 nt, Artificial Sequence
  Description of Artificial Sequence: Synthetic oligonucleotide
gggaggacgaugcggcccugucuguucguccccagacgacucgcccga

SEQ ID NO: 3751 - RNA, 50 nt, Artificial Sequence
  Description of Artificial Sequence: Synthetic oligonucleotide
gggaggacgaugcggcccugugucuguucguccccagacgacucgcccga

SEQ ID NO: 3752 - RNA, 51 nt, Artificial Sequence
  Description of Artificial Sequence: Synthetic oligonucleotide
gggaggacgaugcggccgaagucgucuugccuccccagacgacucgcccga

SEQ ID NO: 3753 - RNA, 51 nt, Artificial Sequence
  Description of Artificial Sequence: Synthetic oligonucleotide
gggaggacgaugcggccgaucgggcugcguugguccagacgacucgcccga

SEQ ID NO: 3754 - RNA, 51 nt, Artificial Sequence
  Description of Artificial Sequence: Synthetic oligonucleotide
gggaggacgaugcggccgaucgucuauucccuccccagacgacucgcccga

SEQ ID NO: 3755 - RNA, 51 nt, Artificial Sequence
  Description of Artificial Sequence: Synthetic oligonucleotide
gggaggacgaugcggccgauucguucugcgcuccccagacgacucgcccga

SEQ ID NO: 3756 - RNA, 51 nt, Artificial Sequence
  Description of Artificial Sequence: Synthetic oligonucleotide
gggaggacgaugcggccgggucucuguuuacuccccagacgacucgcccga

SEQ ID NO: 3757 - RNA, 51 nt, Artificial Sequence
  Description of Artificial Sequence: Synthetic oligonucleotide
gggaggacgaugcggccgucgucugucaaccuccccagacgacucgcccga

SEQ ID NO: 3758 - RNA, 49 nt, Artificial Sequence
  Description of Artificial Sequence: Synthetic oligonucleotide
gggaggacgaugcggccgucgucuguucguccccagacgacucgcccga

SEQ ID NO: 3759 - RNA, 51 nt, Artificial Sequence
  Description of Artificial Sequence: Synthetic oligonucleotide
gggaggacgaugcggccucaguagugggccugcugcagacgacucgcccga

SEQ ID NO: 3760 - RNA, 51 nt, Artificial Sequence
  Description of Artificial Sequence: Synthetic oligonucleotide
gggaggacgaugcggccugauucgucugcgcuccccagacgacucgcccga

SEQ ID NO: 3761 - RNA, 50 nt, Artificial Sequence
  Description of Artificial Sequence: Synthetic oligonucleotide
gggaggacgaugcggccugucgccuguucguccccagacgacucgcccga

SEQ ID NO: 3762 - RNA, 49 nt, Artificial Sequence
  Description of Artificial Sequence: Synthetic oligonucleotide
gggaggacgaugcggccugucgucuuucguccccagacgacucgcccga

SEQ ID NO: 3763 - RNA, 51 nt, Artificial Sequence
  Description of Artificial Sequence: Synthetic oligonucleotide
gggaggacgaugcggccugucgucuuuugcguccccagacgacucgcccga

SEQ ID NO: 3764 - RNA, 50 nt, Artificial Sequence
  Description of Artificial Sequence: Synthetic oligonucleotide
gggaggacgaugcggccugucguuuguucguccccagacgacucgcccga

SEQ ID NO: 3765 - RNA, 51 nt, Artificial Sequence
  Description of Artificial Sequence: Synthetic oligonucleotide
gggaggacgaugcggccuguugucuguugucuccccagacgacucgcccga

SEQ ID NO: 3766 - RNA, 51 nt, Artificial Sequence
  Description of Artificial Sequence: Synthetic oligonucleotide
gggaggacgaugcggccuucgucuguugucucccccagacgacucgcccga

SEQ ID NO: 3767 - RNA, 51 nt, Artificial Sequence
  Description of Artificial Sequence: Synthetic oligonucleotide
gggaggacgaugcggccuucguucugaacccuccccagacgacucgcccga

SEQ ID NO: 3768 - RNA, 51 nt, Artificial Sequence
  Description of Artificial Sequence: Synthetic oligonucleotide
gggaggacgaugcggcgaauuguucugccccuccccagacgacucgcccga

SEQ ID NO: 3769 - RNA, 51 nt, Artificial Sequence
  Description of Artificial Sequence: Synthetic oligonucleotide
gggaggacgaugcggcgacccgucuguuuccuccccagacgacucgcccga

SEQ ID NO: 3770 - RNA, 51 nt, Artificial Sequence
  Description of Artificial Sequence: Synthetic oligonucleotide
gggaggacgaugcggcgacuccucugcaccuuccccagacgacucgcccga

SEQ ID NO: 3771 - RNA, 51 nt, Artificial Sequence
  Description of Artificial Sequence: Synthetic oligonucleotide
gggaggacgaugcggcgacucgugugcuuccgccccagacgacucgcccga

SEQ ID NO: 3772 - RNA, 51 nt, Artificial Sequence
  Description of Artificial Sequence: Synthetic oligonucleotide
gggaggacgaugcggcgacucguucuuuucguccccagacgacucgcccga

SEQ ID NO: 3773 - RNA, 51 nt, Artificial Sequence
  Description of Artificial Sequence: Synthetic oligonucleotide
gggaggacgaugcggcgacucucuguauuccuccccagacgacucgcccga

SEQ ID NO: 3774 - RNA, 51 nt, Artificial Sequence
  Description of Artificial Sequence: Synthetic oligonucleotide
gggaggacgaugcggcgacuuucgucugcacuccccagacgacucgcccga

SEQ ID NO: 3775 - RNA, 51 nt, Artificial Sequence
  Description of Artificial Sequence: Synthetic oligonucleotide
gggaggacgaugcggcgauccucuggacucguccccagacgacucgcccga

SEQ ID NO: 3776 - RNA, 51 nt, Artificial Sequence
  Description of Artificial Sequence: Synthetic oligonucleotide
gggaggacgaugcggcgaucgucuuugcucguccccagacgacucgcccga

SEQ ID NO: 3777 - RNA, 51 nt, Artificial Sequence
  Description of Artificial Sequence: Synthetic oligonucleotide
gggaggacgaugcggcgaucguucugcaccugccccagacgacucgcccga

SEQ ID NO: 3778 - RNA, 51 nt, Artificial Sequence
  Description of Artificial Sequence: Synthetic oligonucleotide
gggaggacgaugcggcgaucguugucuggccuccccagacgacucgcccga

SEQ ID NO: 3779 - RNA, 51 nt, Artificial Sequence
  Description of Artificial Sequence: Synthetic oligonucleotide
gggaggacgaugcggcgaucuccucuguaccuccccagacgacucgcccga

SEQ ID NO: 3780 - RNA, 51 nt, Artificial Sequence
  Description of Artificial Sequence: Synthetic oligonucleotide
gggaggacgaugcggcgauggucugauuccugccccagacgacucgcccga

SEQ ID NO: 3781 - RNA, 51 nt, Artificial Sequence
  Description of Artificial Sequence: Synthetic oligonucleotide
gggaggacgaugcggcgauuccucugaucccuccccagacgacucgcccga

SEQ ID NO: 3782 - RNA, 51 nt, Artificial Sequence
  Description of Artificial Sequence: Synthetic oligonucleotide
gggaggacgaugcggcgcauggucgucuuacuccccagacgacucgcccga

SEQ ID NO: 3783 - RNA, 51 nt, Artificial Sequence
  Description of Artificial Sequence: Synthetic oligonucleotide
gggaggacgaugcggcgcgacucgucucucguccccagacgacucgcccga

SEQ ID NO: 3784 - RNA, 51 nt, Artificial Sequence
  Description of Artificial Sequence: Synthetic oligonucleotide
gggaggacgaugcggcgcuccgucugauugcuccccagacgacucgcccga

SEQ ID NO: 3785 - RNA, 51 nt, Artificial Sequence
  Description of Artificial Sequence: Synthetic oligonucleotide
gggaggacgaugcggcgggccucugcuuucuuccccagacgacucgcccga

SEQ ID NO: 3786 - RNA, 51 nt, Artificial Sequence
  Description of Artificial Sequence: Synthetic oligonucleotide
gggaggacgaugcggcggucguucugacaccuccccagacgacucgcccga

SEQ ID NO: 3787 - RNA, 51 nt, Artificial Sequence
  Description of Artificial Sequence: Synthetic oligonucleotide
gggaggacgaugcggcggucguuugcuguccaccccagacgacucgcccga

SEQ ID NO: 3788 - RNA, 51 nt, Artificial Sequence
  Description of Artificial Sequence: Synthetic oligonucleotide
gggaggacgaugcggcgucucgucuaccagucccccagacgacucgcccga

SEQ ID NO: 3789 - RNA, 51 nt, Artificial Sequence
  Description of Artificial Sequence: Synthetic oligonucleotide
gggaggacgaugcggcgucucguuugguaccuccccagacgacucgcccga

SEQ ID NO: 3790 - RNA, 51 nt, Artificial Sequence
  Description of Artificial Sequence: Synthetic oligonucleotide
gggaggacgaugcggcgucucguuuguuuccuccccagacgacucgcccga

SEQ ID NO: 3791 - RNA, 51 nt, Artificial Sequence
  Description of Artificial Sequence: Synthetic oligonucleotide
gggaggacgaugcggcgucuugucugugccucccccagacgacucgcccga

SEQ ID NO: 3792 - RNA, 51 nt, Artificial Sequence
  Description of Artificial Sequence: Synthetic oligonucleotide
gggaggacgaugcggcgugcucgucuuugccuccccagacgacucgcccga

SEQ ID NO: 3793 - RNA, 50 nt, Artificial Sequence
  Description of Artificial Sequence: Synthetic oligonucleotide
gggaggacgaugcggcguucgucuguugggccgccagacgacucgcccga

SEQ ID NO: 3794 - RNA, 51 nt, Artificial Sequence
  Description of Artificial Sequence: Synthetic oligonucleotide
gggaggacgaugcggcguuuccuccgguucguccccagacgacucgcccga

SEQ ID NO: 3795 - RNA, 51 nt, Artificial Sequence
  Description of Artificial Sequence: Synthetic oligonucleotide
gggaggacgaugcggcguuuccucugguucgcccccagacgacucgcccga

SEQ ID NO: 3796 - RNA, 52 nt, Artificial Sequence
  Description of Artificial Sequence: Synthetic oligonucleotide
gggaggacgaugcggcguuucguuuguuuucguccccagacgacucgcccga

SEQ ID NO: 3797 - RNA, 48 nt, Artificial Sequence
  Description of Artificial Sequence: Synthetic oligonucleotide
gggaggacgaugcggcguuucugguucguccccagacgacucgcccga

SEQ ID NO: 3798 - RNA, 51 nt, Artificial Sequence
  Description of Artificial Sequence: Synthetic oligonucleotide
gggaggacgaugcggcuaguccgucugagugccgccagacgacucgcccga

SEQ ID NO: 3799 - RNA, 51 nt, Artificial Sequence
  Description of Artificial Sequence: Synthetic oligonucleotide
gggaggacgaugcggcugucgaggcugcguugguccagacgacucgcccga

SEQ ID NO: 3800 - RNA, 51 nt, Artificial Sequence
  Description of Artificial Sequence: Synthetic oligonucleotide
gggaggacgaugcggcuuguugucuguguccgccccagacgacucgcccga

SEQ ID NO: 3801 - RNA, 51 nt, Artificial Sequence
  Description of Artificial Sequence: Synthetic oligonucleotide
gggaggacgaugcggcuuguuguucugaaccuccccagacgacucgcccga

SEQ ID NO: 3802 - RNA, 51 nt, Artificial Sequence
  Description of Artificial Sequence: Synthetic oligonucleotide
gggaggacgaugcgggacacucgucugacccuccccagacgacucgcccga

SEQ ID NO: 3803 - RNA, 51 nt, Artificial Sequence
  Description of Artificial Sequence: Synthetic oligonucleotide
gggaggacgaugcgggacgauucuucugcacuccccagacgacucgcccga

SEQ ID NO: 3804 - RNA, 50 nt, Artificial Sequence
  Description of Artificial Sequence: Synthetic oligonucleotide
gggaggacgaugcgggacuauauggggcucugugcagacgacucgcccga

SEQ ID NO: 3805 - RNA, 51 nt, Artificial Sequence
  Description of Artificial Sequence: Synthetic oligonucleotide
gggaggacgaugcgggacuugucguuugaccuccccagacgacucgcccga

SEQ ID NO: 3806 - RNA, 51 nt, Artificial Sequence
  Description of Artificial Sequence: Synthetic oligonucleotide
gggaggacgaugcgggagauguucgucugccuccccagacgacucgcccga

SEQ ID NO: 3807 - RNA, 51 nt, Artificial Sequence
  Description of Artificial Sequence: Synthetic oligonucleotide
gggaggacgaugcgggaguuuccucuguuaguccccagacgacucgcccga

SEQ ID NO: 3808 - RNA, 51 nt, Artificial Sequence
  Description of Artificial Sequence: Synthetic oligonucleotide
gggaggacgaugcgggaguuucgccuguuggccgccagacgacucgcccga

SEQ ID NO: 3809 - RNA, 51 nt, Artificial Sequence
  Description of Artificial Sequence: Synthetic oligonucleotide
gggaggacgaugcgggaguuucgucuguccguccccagacgacucgcccga

SEQ ID NO: 3810 - RNA, 51 nt, Artificial Sequence
  Description of Artificial Sequence: Synthetic oligonucleotide
gggaggacgaugcgggcagcgucuauauucguccccagacgacucgcccga

SEQ ID NO: 3811 - RNA, 51 nt, Artificial Sequence
  Description of Artificial Sequence: Synthetic oligonucleotide
gggaggacgaugcgggcauucgucuuuagccuccccagacgacucgcccga

SEQ ID NO: 3812 - RNA, 51 nt, Artificial Sequence
  Description of Artificial Sequence: Synthetic oligonucleotide
gggaggacgaugcgggcauuuccucuguucguccccagacgacucgcccga

SEQ ID NO: 3813 - RNA, 51 nt, Artificial Sequence
  Description of Artificial Sequence: Synthetic oligonucleotide
gggaggacgaugcgggccacagucguuuucguccccagacgacucgcccga

SEQ ID NO: 3814 - RNA, 51 nt, Artificial Sequence
  Description of Artificial Sequence: Synthetic oligonucleotide
gggaggacgaugcgggccauucgucuucucguccccagacgacucgcccga

SEQ ID NO: 3815 - RNA, 51 nt, Artificial Sequence
  Description of Artificial Sequence: Synthetic oligonucleotide
gggaggacgaugcgggccauucguuugugugccgccagacgacucgcccga

SEQ ID NO: 3816 - RNA, 51 nt, Artificial Sequence
  Description of Artificial Sequence: Synthetic oligonucleotide
gggaggacgaugcgggccauucuucugccacuccccagacgacucgcccga

SEQ ID NO: 3817 - RNA, 51 nt, Artificial Sequence
  Description of Artificial Sequence: Synthetic oligonucleotide
gggaggacgaugcgggcccgucguuuugcgcuccccagacgacucgcccga

SEQ ID NO: 3818 - RNA, 50 nt, Artificial Sequence
  Description of Artificial Sequence: Synthetic oligonucleotide
gggaggacgaugcgggcccgucucuguagcuccccagacgacucgcccga

SEQ ID NO: 3819 - RNA, 51 nt, Artificial Sequence
  Description of Artificial Sequence: Synthetic oligonucleotide
gggaggacgaugcgggcccguucgucuucuguccccagacgacucgcccga

SEQ ID NO: 3820 - RNA, 51 nt, Artificial Sequence
  Description of Artificial Sequence: Synthetic oligonucleotide
gggaggacgaugcgggcccucguucugcuacuccccagacgacucgcccga

SEQ ID NO: 3821 - RNA, 51 nt, Artificial Sequence
  Description of Artificial Sequence: Synthetic oligonucleotide
gggaggacgaugcgggcccucguucugcuucuccccagacgacucgcccga

SEQ ID NO: 3822 - RNA, 51 nt, Artificial Sequence
  Description of Artificial Sequence: Synthetic oligonucleotide
gggaggacgaugcgggcccucucgucuguuguccccagacgacucgcccga

SEQ ID NO: 3823 - RNA, 52 nt, Artificial Sequence
  Description of Artificial Sequence: Synthetic oligonucleotide
gggaggacgaugcgggcccugccgccuguucgcccccagacgacucgcccga

SEQ ID NO: 3824 - RNA, 51 nt, Artificial Sequence
  Description of Artificial Sequence: Synthetic oligonucleotide
gggaggacgaugcgggcccugucguuuucccuccccagacgacucgcccga

SEQ ID NO: 3825 - RNA, 51 nt, Artificial Sequence
  Description of Artificial Sequence: Synthetic oligonucleotide
gggaggacgaugcgggcccuucgucuguucguccccagacgacucgcccga

SEQ ID NO: 3826 - RNA, 51 nt, Artificial Sequence
  Description of Artificial Sequence: Synthetic oligonucleotide
gggaggacgaugcgggcccuuucguuuguacuccccagacgacucgcccga

SEQ ID NO: 3827 - RNA, 51 nt, Artificial Sequence
  Description of Artificial Sequence: Synthetic oligonucleotide
gggaggacgaugcgggccuaguugucuagccuccccagacgacucgcccga

SEQ ID NO: 3828 - RNA, 51 nt, Artificial Sequence
  Description of Artificial Sequence: Synthetic oligonucleotide
gggaggacgaugcgggccuccucgucuguuguccccagacgacucgcccga

SEQ ID NO: 3829 - RNA, 51 nt, Artificial Sequence
  Description of Artificial Sequence: Synthetic oligonucleotide
gggaggacgaugcgggccucgucugucauucuccccagacgacucgcccga

SEQ ID NO: 3830 - RNA, 51 nt, Artificial Sequence
  Description of Artificial Sequence: Synthetic oligonucleotide
gggaggacgaugcgggccucuugucugugcuuccccagacgacucgcccga

SEQ ID NO: 3831 - RNA, 50 nt, Artificial Sequence
  Description of Artificial Sequence: Synthetic oligonucleotide
gggaggacgaugcgggccuucguucugaccuccccagacgacucgcccga

SEQ ID NO: 3832 - RNA, 51 nt, Artificial Sequence
  Description of Artificial Sequence: Synthetic oligonucleotide
gggaggacgaugcgggccuucucgucuuuucuccccagacgacucgcccga

SEQ ID NO: 3833 - RNA, 51 nt, Artificial Sequence
  Description of Artificial Sequence: Synthetic oligonucleotide
gggaggacgaugcgggccuuuccucugugugccgccagacgacucgcccga

SEQ ID NO: 3834 - RNA, 51 nt, Artificial Sequence
  Description of Artificial Sequence: Synthetic oligonucleotide
gggaggacgaugcgggccuuucgaucugcccucuccagacgacucgcccga

SEQ ID NO: 3835 - RNA, 51 nt, Artificial Sequence
  Description of Artificial Sequence: Synthetic oligonucleotide
gggaggacgaugcgggccuuucgucguugugccgccagacgacucgcccga

SEQ ID NO: 3836 - RNA, 51 nt, Artificial Sequence
  Description of Artificial Sequence: Synthetic oligonucleotide
gggaggacgaugcgggccuuucgucuacgcguccccagacgacucgcccga

SEQ ID NO: 3837 - RNA, 51 nt, Artificial Sequence
  Description of Artificial Sequence: Synthetic oligonucleotide
gggaggacgaugcgggccuuucguucugacauccccagacgacucgcccga

SEQ ID NO: 3838 - RNA, 51 nt, Artificial Sequence
  Description of Artificial Sequence: Synthetic oligonucleotide
gggaggacgaugcgggccuuucguucugacccccccagacgacucgcccga

SEQ ID NO: 3839 - RNA, 51 nt, Artificial Sequence
  Description of Artificial Sequence: Synthetic oligonucleotide
gggaggacgaugcgggcgaucgauguagccgcguccagacgacucgcccga

SEQ ID NO: 3840 - RNA, 51 nt, Artificial Sequence
  Description of Artificial Sequence: Synthetic oligonucleotide
gggaggacgaugcgggcgcuucuucugcgucuccccagacgacucgcccga

SEQ ID NO: 3841 - RNA, 51 nt, Artificial Sequence
  Description of Artificial Sequence: Synthetic oligonucleotide
gggaggacgaugcgggcgcuucuucuguucguccccagacgacucgcccga

SEQ ID NO: 3842 - RNA, 51 nt, Artificial Sequence
  Description of Artificial Sequence: Synthetic oligonucleotide
gggaggacgaugcgggcgucgucuaauaucguccccagacgacucgcccga

SEQ ID NO: 3843 - RNA, 51 nt, Artificial Sequence
  Description of Artificial Sequence: Synthetic oligonucleotide
gggaggacgaugcgggcgucguuuguccaccuccccagacgacucgcccga

SEQ ID NO: 3844 - RNA, 50 nt, Artificial Sequence
  Description of Artificial Sequence: Synthetic oligonucleotide
gggaggacgaugcgggcguuccucuguucguccccagacgacucgcccga

SEQ ID NO: 3845 - RNA, 51 nt, Artificial Sequence
  Description of Artificial Sequence: Synthetic oligonucleotide
gggaggacgaugcgggcguuucaucuguucguccccagacgacucgcccga

SEQ ID NO: 3846 - RNA, 51 nt, Artificial Sequence
  Description of Artificial Sequence: Synthetic oligonucleotide
gggaggacgaugcgggcguuuccucuguucgaccccagacgacucgcccga

SEQ ID NO: 3847 - RNA, 51 nt, Artificial Sequence
  Description of Artificial Sequence: Synthetic oligonucleotide
gggaggacgaugcgggcuagcuucugguucguccccagacgacucgcccga

SEQ ID NO: 3848 - RNA, 51 nt, Artificial Sequence
  Description of Artificial Sequence: Synthetic oligonucleotide
gggaggacgaugcgggcuccugucgucuaucuccccagacgacucgcccga

SEQ ID NO: 3849 - RNA, 51 nt, Artificial Sequence
  Description of Artificial Sequence: Synthetic oligonucleotide
gggaggacgaugcgggcucuucgucuugcccuccccagacgacucgcccga

SEQ ID NO: 3850 - RNA, 51 nt, Artificial Sequence
  Description of Artificial Sequence: Synthetic oligonucleotide
gggaggacgaugcgggcugcucgucuuugccuccccagacgacucgcccga

SEQ ID NO: 3851 - RNA, 51 nt, Artificial Sequence
  Description of Artificial Sequence: Synthetic oligonucleotide
gggaggacgaugcgggcugucguacuuuucguccccagacgacucgcccga

SEQ ID NO: 3852 - RNA, 51 nt, Artificial Sequence
  Description of Artificial Sequence: Synthetic oligonucleotide
gggaggacgaugcgggcuugccuucuguucguccccagacgacucgcccga

SEQ ID NO: 3853 - RNA, 51 nt, Artificial Sequence
  Description of Artificial Sequence: Synthetic oligonucleotide
gggaggacgaugcgggcuuggacgucuugccuccccagacgacucgcccga

SEQ ID NO: 3854 - RNA, 51 nt, Artificial Sequence
  Description of Artificial Sequence: Synthetic oligonucleotide
gggaggacgaugcgggcuugucuucuguuuguccccagacgacucgcccga

SEQ ID NO: 3855 - RNA, 51 nt, Artificial Sequence
  Description of Artificial Sequence: Synthetic oligonucleotide
gggaggacgaugcgggcuuuucguucugacguccccagacgacucgcccga

SEQ ID NO: 3856 - RNA, 53 nt, Artificial Sequence
  Description of Artificial Sequence: Synthetic oligonucleotide
gggaggacgaugcgggguccugucgucuguucguccccagacgacucgcccga

SEQ ID NO: 3857 - RNA, 51 nt, Artificial Sequence
  Description of Artificial Sequence: Synthetic oligonucleotide
gggaggacgaugcgggucacucgucugcgccuccccagacgacucgcccga

SEQ ID NO: 3858 - RNA, 51 nt, Artificial Sequence
  Description of Artificial Sequence: Synthetic oligonucleotide
gggaggacgaugcggguccaguugucugcccuccccagacgacucgcccga

SEQ ID NO: 3859 - RNA, 52 nt, Artificial Sequence
  Description of Artificial Sequence: Synthetic oligonucleotide
gggaggacgaugcggguccauucugguuuccugccccagacgacucgcccga

SEQ ID NO: 3860 - RNA, 51 nt, Artificial Sequence
  Description of Artificial Sequence: Synthetic oligonucleotide
gggaggacgaugcggguccgucgucuguucguccccagacgacucgcccga

SEQ ID NO: 3861 - RNA, 52 nt, Artificial Sequence
  Description of Artificial Sequence: Synthetic oligonucleotide
gggaggacgaugcggguccuguagucuguucguacccagacgacucgcccga

SEQ ID NO: 3862 - RNA, 52 nt, Artificial Sequence
  Description of Artificial Sequence: Synthetic oligonucleotide
gggaggacgaugcggguccugucgacuguucguccccagacgacucgcccga

SEQ ID NO: 3863 - RNA, 52 nt, Artificial Sequence
  Description of Artificial Sequence: Synthetic oligonucleotide
gggaggacgaugcggguccugucggcuguucguccccagacgacucgcccga

SEQ ID NO: 3864 - RNA, 51 nt, Artificial Sequence
  Description of Artificial Sequence: Synthetic oligonucleotide
gggaggacgaugcggguccugucgucgaugcuccccagacgacucgcccga

SEQ ID NO: 3865 - RNA, 52 nt, Artificial Sequence
  Description of Artificial Sequence: Synthetic oligonucleotide
gggaggacgaugcggguccugucgucugguuguccccagacgacucgcccga

SEQ ID NO: 3866 - RNA, 50 nt, Artificial Sequence
  Description of Artificial Sequence: Synthetic oligonucleotide
gggaggacgaugcggguccugucgucuguucccccagacgacucgcccga

SEQ ID NO: 3867 - RNA, 51 nt, Artificial Sequence
  Description of Artificial Sequence: Synthetic oligonucleotide
gggaggacgaugcggguccugucgucuguuccccccagacgacucgcccga

SEQ ID NO: 3868 - RNA, 52 nt, Artificial Sequence
  Description of Artificial Sequence: Synthetic oligonucleotide
gggaggacgaugcggguccugucgucuguucggccccagacgacucgcccga

SEQ ID NO: 3869 - RNA, 50 nt, Artificial Sequence
  Description of Artificial Sequence: Synthetic oligonucleotide
gggaggacgaugcggguccugucgucuucguccccagacgacucgcccga

SEQ ID NO: 3870 - RNA, 52 nt, Artificial Sequence
  Description of Artificial Sequence: Synthetic oligonucleotide
gggaggacgaugcggguccugucuucuguucguccccagacgacucgcccga

SEQ ID NO: 3871 - RNA, 51 nt, Artificial Sequence
  Description of Artificial Sequence: Synthetic oligonucleotide
gggaggacgaugcgggucgucuugcucaucguccccagacgacucgcccga

SEQ ID NO: 3872 - RNA, 51 nt, Artificial Sequence
  Description of Artificial Sequence: Synthetic oligonucleotide
gggaggacgaugcgggucgugcuguguuuccuccccagacgacucgcccga

SEQ ID NO: 3873 - RNA, 51 nt, Artificial Sequence
  Description of Artificial Sequence: Synthetic oligonucleotide
gggaggacgaugcgggucgugucguuugcccuccccagacgacucgcccga

SEQ ID NO: 3874 - RNA, 51 nt, Artificial Sequence
  Description of Artificial Sequence: Synthetic oligonucleotide
gggaggacgaugcgggucguuaacugguuccuccccagacgacucgcccga

SEQ ID NO: 3875 - RNA, 51 nt, Artificial Sequence
  Description of Artificial Sequence: Synthetic oligonucleotide
gggaggacgaugcgggucguucugucuaucguccccagacgacucgcccga

SEQ ID NO: 3876 - RNA, 51 nt, Artificial Sequence
  Description of Artificial Sequence: Synthetic oligonucleotide
gggaggacgaugcgggugacucucugguucguccccagacgacucgcccga

SEQ ID NO: 3877 - RNA, 51 nt, Artificial Sequence
  Description of Artificial Sequence: Synthetic oligonucleotide
gggaggacgaugcgggugauucguugcuguccccccagacgacucgcccga

SEQ ID NO: 3878 - RNA, 51 nt, Artificial Sequence
  Description of Artificial Sequence: Synthetic oligonucleotide
gggaggacgaugcgggugauucuucuggcccuccccagacgacucgcccga

SEQ ID NO: 3879 - RNA, 51 nt, Artificial Sequence
  Description of Artificial Sequence: Synthetic oligonucleotide
gggaggacgaugcgggugauugcgucucacguccccagacgacucgcccga

SEQ ID NO: 3880 - RNA, 50 nt, Artificial Sequence
  Description of Artificial Sequence: Synthetic oligonucleotide
gggaggacgaugcgggugcucgucuguucguccccagacgacucgcccga

SEQ ID NO: 3881 - RNA, 51 nt, Artificial Sequence
  Description of Artificial Sequence: Synthetic oligonucleotide
gggaggacgaugcgggugguucguuugucccuccccagacgacucgcccga

SEQ ID NO: 3882 - RNA, 51 nt, Artificial Sequence
  Description of Artificial Sequence: Synthetic oligonucleotide
gggaggacgaugcggguugauuucgucuugcuccccagacgacucgcccga

SEQ ID NO: 3883 - RNA, 52 nt, Artificial Sequence
  Description of Artificial Sequence: Synthetic oligonucleotide
gggaggacgaugcggguugggguuuuucccgugccccagacgacucgcccga

SEQ ID NO: 3884 - RNA, 51 nt, Artificial Sequence
  Description of Artificial Sequence: Synthetic oligonucleotide
gggaggacgaugcgguaaugucguauguucguccccagacgacucgcccga

SEQ ID NO: 3885 - RNA, 51 nt, Artificial Sequence
  Description of Artificial Sequence: Synthetic oligonucleotide
gggaggacgaugcgguaaugucgucuguucguccacagacgacucgcccga

SEQ ID NO: 3886 - RNA, 51 nt, Artificial Sequence
  Description of Artificial Sequence: Synthetic oligonucleotide
gggaggacgaugcgguacuguagucuguucguccacagacgacucgcccga

SEQ ID NO: 3887 - RNA, 51 nt, Artificial Sequence
  Description of Artificial Sequence: Synthetic oligonucleotide
gggaggacgaugcgguacugucguauguuaguccccagacgacucgcccga

SEQ ID NO: 3888 - RNA, 51 nt, Artificial Sequence
  Description of Artificial Sequence: Synthetic oligonucleotide
gggaggacgaugcgguacugucgucuguucauccccagacgacucgcccga

SEQ ID NO: 3889 - RNA, 51 nt, Artificial Sequence
  Description of Artificial Sequence: Synthetic oligonucleotide
gggaggacgaugcgguacugucgucuguucgucuccagacgacucgcccga

SEQ ID NO: 3890 - RNA, 51 nt, Artificial Sequence
  Description of Artificial Sequence: Synthetic oligonucleotide
gggaggacgaugcgguacugucgucuguucguucccagacgacucgcccga

SEQ ID NO: 3891 - RNA, 51 nt, Artificial Sequence
  Description of Artificial Sequence: Synthetic oligonucleotide
gggaggacgaugcgguacuguugucuguucguccccagacgacucgcccga

SEQ ID NO: 3892 - RNA, 51 nt, Artificial Sequence
  Description of Artificial Sequence: Synthetic oligonucleotide
gggaggacgaugcgguagucucuggguucccgccccagacgacucgcccga

SEQ ID NO: 3893 - RNA, 51 nt, Artificial Sequence
  Description of Artificial Sequence: Synthetic oligonucleotide
gggaggacgaugcgguauugucgucuguucguccccagacgacucgcccga

SEQ ID NO: 3894 - RNA, 51 nt, Artificial Sequence
  Description of Artificial Sequence: Synthetic oligonucleotide
gggaggacgaugcggucauguagucuguucgucaccagacgacucgcccga

SEQ ID NO: 3895 - RNA, 51 nt, Artificial Sequence
  Description of Artificial Sequence: Synthetic oligonucleotide
gggaggacgaugcggucaugucguauguucgucaccagacgacucgcccga

SEQ ID NO: 3896 - RNA, 51 nt, Artificial Sequence
  Description of Artificial Sequence: Synthetic oligonucleotide
gggaggacgaugcggucaugucguauguucguccacagacgacucgcccga

SEQ ID NO: 3897 - RNA, 51 nt, Artificial Sequence
  Description of Artificial Sequence: Synthetic oligonucleotide
gggaggacgaugcggucaugucgucaguucguccccagacgacucgcccga

SEQ ID NO: 3898 - RNA, 51 nt, Artificial Sequence
  Description of Artificial Sequence: Synthetic oligonucleotide
gggaggacgaugcggucaugucgucugcucguccccagacgacucgcccga

SEQ ID NO: 3899 - RNA, 51 nt, Artificial Sequence
  Description of Artificial Sequence: Synthetic oligonucleotide
gggaggacgaugcggucaugucgucuguucauccccagacgacucgcccga

SEQ ID NO: 3900 - RNA, 51 nt, Artificial Sequence
  Description of Artificial Sequence: Synthetic oligonucleotide
gggaggacgaugcgguccagucgucuguucguccacagacgacucgcccga

SEQ ID NO: 3901 - RNA, 51 nt, Artificial Sequence
  Description of Artificial Sequence: Synthetic oligonucleotide
gggaggacgaugcggucccguccuuuuacccuccccagacgacucgcccga

SEQ ID NO: 3902 - RNA, 51 nt, Artificial Sequence
  Description of Artificial Sequence: Synthetic oligonucleotide
gggaggacgaugcggucccgucgucuguucguacccagacgacucgcccga

SEQ ID NO: 3903 - RNA, 51 nt, Artificial Sequence
  Description of Artificial Sequence: Synthetic oligonucleotide
gggaggacgaugcggucccgucgucuguucguccucagacgacucgcccga

SEQ ID NO: 3904 - RNA, 51 nt, Artificial Sequence
  Description of Artificial Sequence: Synthetic oligonucleotide
gggaggacgaugcggucccgucuucuguucguccccagacgacucgcccga

SEQ ID NO: 3905 - RNA, 51 nt, Artificial Sequence
  Description of Artificial Sequence: Synthetic oligonucleotide
gggaggacgaugcggucccucgucuguucccuccccagacgacucgcccga

SEQ ID NO: 3906 - RNA, 51 nt, Artificial Sequence
  Description of Artificial Sequence: Synthetic oligonucleotide
gggaggacgaugcgguccuaucgucuguuccuccccagacgacucgcccga

SEQ ID NO: 3907 - RNA, 51 nt, Artificial Sequence
  Description of Artificial Sequence: Synthetic oligonucleotide
gggaggacgaugcgguccuaucgucuuuucguccccagacgacucgcccga

SEQ ID NO: 3908 - RNA, 49 nt, Artificial Sequence
  Description of Artificial Sequence: Synthetic oligonucleotide
gggaggacgaugcgguccucgucuguucguccccagacgacucgcccga

SEQ ID NO: 3909 - RNA, 51 nt, Artificial Sequence
  Description of Artificial Sequence: Synthetic oligonucleotide
gggaggacgaugcgguccugacguauguucguccccagacgacucgcccga

SEQ ID NO: 3910 - RNA, 51 nt, Artificial Sequence
  Description of Artificial Sequence: Synthetic oligonucleotide
gggaggacgaugcgguccugacgucugaucguccccagacgacucgcccga

SEQ ID NO: 3911 - RNA, 51 nt, Artificial Sequence
  Description of Artificial Sequence: Synthetic oligonucleotide
gggaggacgaugcgguccugacgucuguucguacacagacgacucgcccga

SEQ ID NO: 3912 - RNA, 51 nt, Artificial Sequence
  Description of Artificial Sequence: Synthetic oligonucleotide
gggaggacgaugcgguccugacgucuguucgucuccagacgacucgcccga

SEQ ID NO: 3913 - RNA, 51 nt, Artificial Sequence
  Description of Artificial Sequence: Synthetic oligonucleotide
gggaggacgaugcgguccugcccucuguucguccccagacgacucgcccga

SEQ ID NO: 3914 - RNA, 51 nt, Artificial Sequence
  Description of Artificial Sequence: Synthetic oligonucleotide
gggaggacgaugcgguccugccgucuguccguccccagacgacucgcccga

SEQ ID NO: 3915 - RNA, 51 nt, Artificial Sequence
  Description of Artificial Sequence: Synthetic oligonucleotide
gggaggacgaugcgguccugccgucuguucgaccccagacgacucgcccga

SEQ ID NO: 3916 - RNA, 51 nt, Artificial Sequence
  Description of Artificial Sequence: Synthetic oligonucleotide
gggaggacgaugcgguccugccgucuguucguacccagacgacucgcccga

SEQ ID NO: 3917 - RNA, 51 nt, Artificial Sequence
  Description of Artificial Sequence: Synthetic oligonucleotide
gggaggacgaugcgguccugccgucuguucguccacagacgacucgcccga

SEQ ID NO: 3918 - RNA, 51 nt, Artificial Sequence
  Description of Artificial Sequence: Synthetic oligonucleotide
gggaggacgaugcgguccugccgucuuuucguccccagacgacucgcccga

SEQ ID NO: 3919 - RNA, 51 nt, Artificial Sequence
  Description of Artificial Sequence: Synthetic oligonucleotide
gggaggacgaugcgguccugccguuuguucguccccagacgacucgcccga

SEQ ID NO: 3920 - RNA, 50 nt, Artificial Sequence
  Description of Artificial Sequence: Synthetic oligonucleotide
gggaggacgaugcgguccugcuugucguuguccccagacgacucgcccga

SEQ ID NO: 3921 - RNA, 51 nt, Artificial Sequence
  Description of Artificial Sequence: Synthetic oligonucleotide
gggaggacgaugcgguccuggcggcuguucguccccagacgacucgcccga

SEQ ID NO: 3922 - RNA, 51 nt, Artificial Sequence
  Description of Artificial Sequence: Synthetic oligonucleotide
gggaggacgaugcgguccuggcgucuguucggccccagacgacucgcccga

SEQ ID NO: 3923 - RNA, 51 nt, Artificial Sequence
  Description of Artificial Sequence: Synthetic oligonucleotide
gggaggacgaugcgguccuggcuggucguuguccccagacgacucgcccga

SEQ ID NO: 3924 - RNA, 51 nt, Artificial Sequence
  Description of Artificial Sequence: Synthetic oligonucleotide
gggaggacgaugcgguccuggcuugucgauguccccagacgacucgcccga

SEQ ID NO: 3925 - RNA, 50 nt, Artificial Sequence
  Description of Artificial Sequence: Synthetic oligonucleotide
gggaggacgaugcgguccuggcuugucguuguuccagacgacucgcccga

SEQ ID NO: 3926 - RNA, 49 nt, Artificial Sequence
  Description of Artificial Sequence: Synthetic oligonucleotide
gggaggacgaugcgguccuggcuugucguuucccagacgacucgcccga

SEQ ID NO: 3927 - RNA, 51 nt, Artificial Sequence
  Description of Artificial Sequence: Synthetic oligonucleotide
gggaggacgaugcgguccuggguugucguuguccccagacgacucgcccga

SEQ ID NO: 3928 - RNA, 52 nt, Artificial Sequence
  Description of Artificial Sequence: Synthetic oligonucleotide
gggaggacgaugcgguccuggucgucuguucguccccagacgacucgcccga

SEQ ID NO: 3929 - RNA, 51 nt, Artificial Sequence
  Description of Artificial Sequence: Synthetic oligonucleotide
gggaggacgaugcgguccuguacucuguucguccccagacgacucgcccga

SEQ ID NO: 3930 - RNA, 51 nt, Artificial Sequence
  Description of Artificial Sequence: Synthetic oligonucleotide
gggaggacgaugcgguccuguagucaguucguccccagacgacucgcccga

SEQ ID NO: 3931 - RNA, 51 nt, Artificial Sequence
  Description of Artificial Sequence: Synthetic oligonucleotide
gggaggacgaugcgguccuguaguccguucguccccagacgacucgcccga

SEQ ID NO: 3932 - RNA, 51 nt, Artificial Sequence
  Description of Artificial Sequence: Synthetic oligonucleotide
gggaggacgaugcgguccuguagucuguuaguacacagacgacucgcccga

SEQ ID NO: 3933 - RNA, 51 nt, Artificial Sequence
  Description of Artificial Sequence: Synthetic oligonucleotide
gggaggacgaugcgguccuguagucuguucguaaccagacgacucgcccga

SEQ ID NO: 3934 - RNA, 51 nt, Artificial Sequence
  Description of Artificial Sequence: Synthetic oligonucleotide
gggaggacgaugcgguccuguagucuguugguccccagacgacucgcccga

SEQ ID NO: 3935 - RNA, 51 nt, Artificial Sequence
  Description of Artificial Sequence: Synthetic oligonucleotide
gggaggacgaugcgguccuguagucuuuucguccccagacgacucgcccga

SEQ ID NO: 3936 - RNA, 51 nt, Artificial Sequence
  Description of Artificial Sequence: Synthetic oligonucleotide
gggaggacgaugcgguccuguauucuguucguccccagacgacucgcccga

SEQ ID NO: 3937 - RNA, 51 nt, Artificial Sequence
  Description of Artificial Sequence: Synthetic oligonucleotide
gggaggacgaugcgguccugucaucucuucguccccagacgacucgcccga

SEQ ID NO: 3938 - RNA, 51 nt, Artificial Sequence
  Description of Artificial Sequence: Synthetic oligonucleotide
gggaggacgaugcgguccugucaucuguuccuccccagacgacucgcccga

SEQ ID NO: 3939 - RNA, 51 nt, Artificial Sequence
  Description of Artificial Sequence: Synthetic oligonucleotide
gggaggacgaugcgguccuguccccuguucguccccagacgacucgcccga

SEQ ID NO: 3940 - RNA, 50 nt, Artificial Sequence
  Description of Artificial Sequence: Synthetic oligonucleotide
gggaggacgaugcgguccugucccuguucguccccagacgacucgcccga

SEQ ID NO: 3941 - RNA, 51 nt, Artificial Sequence
  Description of Artificial Sequence: Synthetic oligonucleotide
gggaggacgaugcgguccugucgacuguuagucaccagacgacucgcccga

SEQ ID NO: 3942 - RNA, 51 nt, Artificial Sequence
  Description of Artificial Sequence: Synthetic oligonucleotide
gggaggacgaugcgguccugucgccugaucguccccagacgacucgcccga

SEQ ID NO: 3943 - RNA, 51 nt, Artificial Sequence
  Description of Artificial Sequence: Synthetic oligonucleotide
gggaggacgaugcgguccugucgccuguccguccccagacgacucgcccga

SEQ ID NO: 3944 - RNA, 51 nt, Artificial Sequence
  Description of Artificial Sequence: Synthetic oligonucleotide
gggaggacgaugcgguccugucgccuguucauccccagacgacucgcccga

SEQ ID NO: 3945 - RNA, 51 nt, Artificial Sequence
  Description of Artificial Sequence: Synthetic oligonucleotide
gggaggacgaugcgguccugucgccuguucguccacagacgacucgcccga

SEQ ID NO: 3946 - RNA, 51 nt, Artificial Sequence
  Description of Artificial Sequence: Synthetic oligonucleotide
gggaggacgaugcgguccugucgccuguucuuccccagacgacucgcccga

SEQ ID NO: 3947 - RNA, 51 nt, Artificial Sequence
  Description of Artificial Sequence: Synthetic oligonucleotide
gggaggacgaugcgguccugucggcuguucggccccagacgacucgcccga

SEQ ID NO: 3948 - RNA, 51 nt, Artificial Sequence
  Description of Artificial Sequence: Synthetic oligonucleotide
gggaggacgaugcgguccugucguacguucguccccagacgacucgcccga

SEQ ID NO: 3949 - RNA, 51 nt, Artificial Sequence
  Description of Artificial Sequence: Synthetic oligonucleotide
gggaggacgaugcgguccugucguaugaucguccccagacgacucgcccga

SEQ ID NO: 3950 - RNA, 51 nt, Artificial Sequence
  Description of Artificial Sequence: Synthetic oligonucleotide
gggaggacgaugcgguccugucguauggucguccccagacgacucgcccga

SEQ ID NO: 3951 - RNA, 51 nt, Artificial Sequence
  Description of Artificial Sequence: Synthetic oligonucleotide
gggaggacgaugcgguccugucguauguucguaaccagacgacucgcccga

SEQ ID NO: 3952 - RNA, 50 nt, Artificial Sequence
  Description of Artificial Sequence: Synthetic oligonucleotide
gggaggacgaugcgguccugucguauguucgucccagacgacucgcccga

SEQ ID NO: 3953 - RNA, 51 nt, Artificial Sequence
  Description of Artificial Sequence: Synthetic oligonucleotide
gggaggacgaugcgguccugucguauguugguccccagacgacucgcccga

SEQ ID NO: 3954 - RNA, 51 nt, Artificial Sequence
  Description of Artificial Sequence: Synthetic oligonucleotide
gggaggacgaugcgguccugucguauguuuguccccagacgacucgcccga

SEQ ID NO: 3955 - RNA, 51 nt, Artificial Sequence
  Description of Artificial Sequence: Synthetic oligonucleotide
gggaggacgaugcgguccugucgucaguucguacccagacgacucgcccga

SEQ ID NO: 3956 - RNA, 50 nt, Artificial Sequence
  Description of Artificial Sequence: Synthetic oligonucleotide
gggaggacgaugcgguccugucgucauucguccccagacgacucgcccga

SEQ ID NO: 3957 - RNA, 50 nt, Artificial Sequence
  Description of Artificial Sequence: Synthetic oligonucleotide
gggaggacgaugcgguccugucguccaucguccccagacgacucgcccga

SEQ ID NO: 3958 - RNA, 48 nt, Artificial Sequence
  Description of Artificial Sequence: Synthetic oligonucleotide
gggaggacgaugcgguccugucgucucguucccagacgacucgcccga

SEQ ID NO: 3959 - RNA, 51 nt, Artificial Sequence
  Description of Artificial Sequence: Synthetic oligonucleotide
gggaggacgaugcgguccugucgucucuucauccccagacgacucgcccga

SEQ ID NO: 3960 - RNA, 48 nt, Artificial Sequence
  Description of Artificial Sequence: Synthetic oligonucleotide
gggaggacgaugcgguccugucgucucuuccccagacgacucgcccga

SEQ ID NO: 3961 - RNA, 51 nt, Artificial Sequence
  Description of Artificial Sequence: Synthetic oligonucleotide
gggaggacgaugcgguccugucgucugaucgaccccagacgacucgcccga

SEQ ID NO: 3962 - RNA, 49 nt, Artificial Sequence
  Description of Artificial Sequence: Synthetic oligonucleotide
gggaggacgaugcgguccugucgucugcguccccagacgacucgcccga

SEQ ID NO: 3963 - RNA, 51 nt, Artificial Sequence
  Description of Artificial Sequence: Synthetic oligonucleotide
gggaggacgaugcgguccugucgucugcucguacccagacgacucgcccga

SEQ ID NO: 3964 - RNA, 50 nt, Artificial Sequence
  Description of Artificial Sequence: Synthetic oligonucleotide
gggaggacgaugcgguccugucgucugcucguuccagacgacucgcccga

SEQ ID NO: 3965 - RNA, 51 nt, Artificial Sequence
  Description of Artificial Sequence: Synthetic oligonucleotide
gggaggacgaugcgguccugucgucuggucggccccagacgacucgcccga

SEQ ID NO: 3966 - RNA, 50 nt, Artificial Sequence
  Description of Artificial Sequence: Synthetic oligonucleotide
gggaggacgaugcgguccugucgucuguacuccccagacgacucgcccga

SEQ ID NO: 3967 - RNA, 50 nt, Artificial Sequence
  Description of Artificial Sequence: Synthetic oligonucleotide
gggaggacgaugcgguccugucgucuguaguccccagacgacucgcccga

SEQ ID NO: 3968 - RNA, 51 nt, Artificial Sequence
  Description of Artificial Sequence: Synthetic oligonucleotide
gggaggacgaugcgguccugucgucuguccgcccccagacgacucgcccga

SEQ ID NO: 3969 - RNA, 51 nt, Artificial Sequence
  Description of Artificial Sequence: Synthetic oligonucleotide
gggaggacgaugcgguccugucgucuguuaguaaacagacgacucgcccga

SEQ ID NO: 3970 - RNA, 51 nt, Artificial Sequence
  Description of Artificial Sequence: Synthetic oligonucleotide
gggaggacgaugcgguccugucgucuguuagucgccagacgacucgcccga

SEQ ID NO: 3971 - RNA, 51 nt, Artificial Sequence
  Description of Artificial Sequence: Synthetic oligonucleotide
gggaggacgaugcgguccugucgucuguuagucuccagacgacucgcccga

SEQ ID NO: 3972 - RNA, 52 nt, Artificial Sequence
  Description of Artificial Sequence: Synthetic oligonucleotide
gggaggacgaugcgguccugucgucuguucacuccccagacgacucgcccga

SEQ ID NO: 3973 - RNA, 51 nt, Artificial Sequence
  Description of Artificial Sequence: Synthetic oligonucleotide
gggaggacgaugcgguccugucgucuguucauccacagacgacucgcccga

SEQ ID NO: 3974 - RNA, 49 nt, Artificial Sequence
  Description of Artificial Sequence: Synthetic oligonucleotide
gggaggacgaugcgguccugucgucuguucgcccagacgacucgcccga

SEQ ID NO: 3975 - RNA, 50 nt, Artificial Sequence
  Description of Artificial Sequence: Synthetic oligonucleotide
gggaggacgaugcgguccugucgucuguucgcuccagacgacucgcccga

SEQ ID NO: 3976 - RNA, 51 nt, Artificial Sequence
  Description of Artificial Sequence: Synthetic oligonucleotide
gggaggacgaugcgguccugucgucuguucggucccagacgacucgcccga

SEQ ID NO: 3977 - RNA, 51 nt, Artificial Sequence
  Description of Artificial Sequence: Synthetic oligonucleotide
gggaggacgaugcgguccugucgucuguucguacgcagacgacucgcccga

SEQ ID NO: 3978 - RNA, 51 nt, Artificial Sequence
  Description of Artificial Sequence: Synthetic oligonucleotide
gggaggacgaugcgguccugucgucuguucguacucagacgacucgcccga

SEQ ID NO: 3979 - RNA, 50 nt, Artificial Sequence
  Description of Artificial Sequence: Synthetic oligonucleotide
gggaggacgaugcgguccugucgucuguucgucacagacgacucgcccga

SEQ ID NO: 3980 - RNA, 51 nt, Artificial Sequence
  Description of Artificial Sequence: Synthetic oligonucleotide
gggaggacgaugcgguccugucgucuguucgucagcagacgacucgcccga

SEQ ID NO: 3981 - RNA, 52 nt, Artificial Sequence
  Description of Artificial Sequence: Synthetic oligonucleotide
gggaggacgaugcgguccugucgucuguucguccaccagacgacucgcccga

SEQ ID NO: 3982 - RNA, 51 nt, Artificial Sequence
  Description of Artificial Sequence: Synthetic oligonucleotide
gggaggacgaugcgguccugucgucuguucguugccagacgacucgcccga

SEQ ID NO: 3983 - RNA, 50 nt, Artificial Sequence
  Description of Artificial Sequence: Synthetic oligonucleotide
gggaggacgaugcgguccugucgucuguucuuuccagacgacucgcccga

SEQ ID NO: 3984 - RNA, 51 nt, Artificial Sequence
  Description of Artificial Sequence: Synthetic oligonucleotide
gggaggacgaugcgguccugucgucuguugguacccagacgacucgcccga

SEQ ID NO: 3985 - RNA, 51 nt, Artificial Sequence
  Description of Artificial Sequence: Synthetic oligonucleotide
gggaggacgaugcgguccugucgucuguugguccgcagacgacucgcccga

SEQ ID NO: 3986 - RNA, 51 nt, Artificial Sequence
  Description of Artificial Sequence: Synthetic oligonucleotide
gggaggacgaugcgguccugucgucuguugguucccagacgacucgcccga

SEQ ID NO: 3987 - RNA, 49 nt, Artificial Sequence
  Description of Artificial Sequence: Synthetic oligonucleotide
gggaggacgaugcgguccugucgucuguuuccccagacgacucgcccga

SEQ ID NO: 3988 - RNA, 51 nt, Artificial Sequence
  Description of Artificial Sequence: Synthetic oligonucleotide
gggaggacgaugcgguccugucgucuguuugcccccagacgacucgcccga

SEQ ID NO: 3989 - RNA, 50 nt, Artificial Sequence
  Description of Artificial Sequence: Synthetic oligonucleotide
gggaggacgaugcgguccugucgucuuucgcccccagacgacucgcccga

SEQ ID NO: 3990 - RNA, 50 nt, Artificial Sequence
  Description of Artificial Sequence: Synthetic oligonucleotide
gggaggacgaugcgguccugucgucuuucguucccagacgacucgcccga

SEQ ID NO: 3991 - RNA, 51 nt, Artificial Sequence
  Description of Artificial Sequence: Synthetic oligonucleotide
gggaggacgaugcgguccugucguguguucguacccagacgacucgcccga

SEQ ID NO: 3992 - RNA, 51 nt, Artificial Sequence
  Description of Artificial Sequence: Synthetic oligonucleotide
gggaggacgaugcgguccugucguguguucguucccagacgacucgcccga

SEQ ID NO: 3993 - RNA, 51 nt, Artificial Sequence
  Description of Artificial Sequence: Synthetic oligonucleotide
gggaggacgaugcgguccugucguuuguucgucaccagacgacucgcccga

SEQ ID NO: 3994 - RNA, 51 nt, Artificial Sequence
  Description of Artificial Sequence: Synthetic oligonucleotide
gggaggacgaugcgguccugucuucuguuaguccccagacgacucgcccga

SEQ ID NO: 3995 - RNA, 51 nt, Artificial Sequence
  Description of Artificial Sequence: Synthetic oligonucleotide
gggaggacgaugcgguccuguuguauguucguccccagacgacucgcccga

SEQ ID NO: 3996 - RNA, 50 nt, Artificial Sequence
  Description of Artificial Sequence: Synthetic oligonucleotide
gggaggacgaugcgguccuguugucuguucgucccagacgacucgcccga

SEQ ID NO: 3997 - RNA, 51 nt, Artificial Sequence
  Description of Artificial Sequence: Synthetic oligonucleotide
gggaggacgaugcgguccuguugucuguucguccacagacgacucgcccga

SEQ ID NO: 3998 - RNA, 51 nt, Artificial Sequence
  Description of Artificial Sequence: Synthetic oligonucleotide
gggaggacgaugcgguccuguuuucuguucguccccagacgacucgcccga

SEQ ID NO: 3999 - RNA, 51 nt, Artificial Sequence
  Description of Artificial Sequence: Synthetic oligonucleotide
gggaggacgaugcgguccuuucgucugcucguccccagacgacucgcccga

SEQ ID NO: 4000 - RNA, 51 nt, Artificial Sequence
  Description of Artificial Sequence: Synthetic oligonucleotide
gggaggacgaugcgguccuuucgucuguucgcccccagacgacucgcccga

SEQ ID NO: 4001 - RNA, 51 nt, Artificial Sequence
  Description of Artificial Sequence: Synthetic oligonucleotide
gggaggacgaugcgguccuuucgucuguucgucaccagacgacucgcccga

SEQ ID NO: 4002 - RNA, 51 nt, Artificial Sequence
  Description of Artificial Sequence: Synthetic oligonucleotide
gggaggacgaugcggucgaccgucuguuccguccccagacgacucgcccga

SEQ ID NO: 4003 - RNA, 51 nt, Artificial Sequence
  Description of Artificial Sequence: Synthetic oligonucleotide
gggaggacgaugcggucgagcgucuuucucguccccagacgacucgcccga

SEQ ID NO: 4004 - RNA, 53 nt, Artificial Sequence
  Description of Artificial Sequence: Synthetic oligonucleotide
gggaggacgaugcggucgaucgucugauuuucguccccagacgacucgcccga

SEQ ID NO: 4005 - RNA, 51 nt, Artificial Sequence
  Description of Artificial Sequence: Synthetic oligonucleotide
gggaggacgaugcggucgggucucuguucacuccccagacgacucgcccga

SEQ ID NO: 4006 - RNA, 51 nt, Artificial Sequence
  Description of Artificial Sequence: Synthetic oligonucleotide
gggaggacgaugcggucgucucgucugcacucccccagacgacucgcccga

SEQ ID NO: 4007 - RNA, 51 nt, Artificial Sequence
  Description of Artificial Sequence: Synthetic oligonucleotide
gggaggacgaugcggucgucuguuguacgccuccccagacgacucgcccga

SEQ ID NO: 4008 - RNA, 51 nt, Artificial Sequence
  Description of Artificial Sequence: Synthetic oligonucleotide
gggaggacgaugcggucguugucgccugaccuccccagacgacucgcccga

SEQ ID NO: 4009 - RNA, 51 nt, Artificial Sequence
  Description of Artificial Sequence: Synthetic oligonucleotide
gggaggacgaugcggucucagcagugggccugcugcagacgacucgcccga

SEQ ID NO: 4010 - RNA, 51 nt, Artificial Sequence
  Description of Artificial Sequence: Synthetic oligonucleotide
gggaggacgaugcggucucugugcuauucccacgccagacgacucgcccga

SEQ ID NO: 4011 - RNA, 50 nt, Artificial Sequence
  Description of Artificial Sequence: Synthetic oligonucleotide
gggaggacgaugcggucugcgugggauguggccccagacgacucgcccga

SEQ ID NO: 4012 - RNA, 51 nt, Artificial Sequence
  Description of Artificial Sequence: Synthetic oligonucleotide
gggaggacgaugcggucugucugguuuguccucgccagacgacucgcccga

SEQ ID NO: 4013 - RNA, 50 nt, Artificial Sequence
  Description of Artificial Sequence: Synthetic oligonucleotide
gggaggacgaugcggucugugugggaucuggccccagacgacucgcccga

SEQ ID NO: 4014 - RNA, 50 nt, Artificial Sequence
  Description of Artificial Sequence: Synthetic oligonucleotide
gggaggacgaugcggucugugugggguguggccccagacgacucgcccga

SEQ ID NO: 4015 - RNA, 51 nt, Artificial Sequence
  Description of Artificial Sequence: Synthetic oligonucleotide
gggaggacgaugcggucuucuggguuucucggccccagacgacucgcccga

SEQ ID NO: 4016 - RNA, 51 nt, Artificial Sequence
  Description of Artificial Sequence: Synthetic oligonucleotide
gggaggacgaugcggucuucugguguuccugccgccagacgacucgcccga

SEQ ID NO: 4017 - RNA, 51 nt, Artificial Sequence
  Description of Artificial Sequence: Synthetic oligonucleotide
gggaggacgaugcggucuugacgucuguucguccccagacgacucgcccga

SEQ ID NO: 4018 - RNA, 51 nt, Artificial Sequence
  Description of Artificial Sequence: Synthetic oligonucleotide
gggaggacgaugcggucuuguagucuguucguccccagacgacucgcccga

SEQ ID NO: 4019 - RNA, 51 nt, Artificial Sequence
  Description of Artificial Sequence: Synthetic oligonucleotide
gggaggacgaugcggucuuguccucuguucguccccagacgacucgcccga

SEQ ID NO: 4020 - RNA, 51 nt, Artificial Sequence
  Description of Artificial Sequence: Synthetic oligonucleotide
gggaggacgaugcggucuugucggcuguucguccccagacgacucgcccga

SEQ ID NO: 4021 - RNA, 51 nt, Artificial Sequence
  Description of Artificial Sequence: Synthetic oligonucleotide
gggaggacgaugcggucuugucgucuguucgugcccagacgacucgcccga

SEQ ID NO: 4022 - RNA, 50 nt, Artificial Sequence
  Description of Artificial Sequence: Synthetic oligonucleotide
gggaggacgaugcggucuugucgucuuucguccccagacgacucgcccga

SEQ ID NO: 4023 - RNA, 51 nt, Artificial Sequence
  Description of Artificial Sequence: Synthetic oligonucleotide
gggaggacgaugcggucuugucguucuguuguccccagacgacucgcccga

SEQ ID NO: 4024 - RNA, 51 nt, Artificial Sequence
  Description of Artificial Sequence: Synthetic oligonucleotide
gggaggacgaugcggucuuucgucugguucguccccagacgacucgcccga

SEQ ID NO: 4025 - RNA, 51 nt, Artificial Sequence
  Description of Artificial Sequence: Synthetic oligonucleotide
gggaggacgaugcggucuuuggguuugugcugccccagacgacucgcccga

SEQ ID NO: 4026 - RNA, 51 nt, Artificial Sequence
  Description of Artificial Sequence: Synthetic oligonucleotide
gggaggacgaugcggugaccucgucugcaccuccccagacgacucgcccga

SEQ ID NO: 4027 - RNA, 51 nt, Artificial Sequence
  Description of Artificial Sequence: Synthetic oligonucleotide
gggaggacgaugcggugacucgucuguuucguucccagacgacucgcccga

SEQ ID NO: 4028 - RNA, 51 nt, Artificial Sequence
  Description of Artificial Sequence: Synthetic oligonucleotide
gggaggacgaugcggugagucauucccuucguccccagacgacucgcccga

SEQ ID NO: 4029 - RNA, 51 nt, Artificial Sequence
  Description of Artificial Sequence: Synthetic oligonucleotide
gggaggacgaugcggugagucguucccuuccuccccagacgacucgcccga

SEQ ID NO: 4030 - RNA, 51 nt, Artificial Sequence
  Description of Artificial Sequence: Synthetic oligonucleotide
gggaggacgaugcggugagucguucuuuucguccccagacgacucgcccga

SEQ ID NO: 4031 - RNA, 51 nt, Artificial Sequence
  Description of Artificial Sequence: Synthetic oligonucleotide
gggaggacgaugcggugagucguuucauucguccccagacgacucgcccga

SEQ ID NO: 4032 - RNA, 51 nt, Artificial Sequence
  Description of Artificial Sequence: Synthetic oligonucleotide
gggaggacgaugcggugagucguuuucuucguccccagacgacucgcccga

SEQ ID NO: 4033 - RNA, 51 nt, Artificial Sequence
  Description of Artificial Sequence: Synthetic oligonucleotide
gggaggacgaugcggugccugucuucugcgcuccccagacgacucgcccga

SEQ ID NO: 4034 - RNA, 51 nt, Artificial Sequence
  Description of Artificial Sequence: Synthetic oligonucleotide
gggaggacgaugcggugccuuucgucugcgcuccccagacgacucgcccga

SEQ ID NO: 4035 - RNA, 51 nt, Artificial Sequence
  Description of Artificial Sequence: Synthetic oligonucleotide
gggaggacgaugcggugcgacgucuguuuucuccccagacgacucgcccga

SEQ ID NO: 4036 - RNA, 51 nt, Artificial Sequence
  Description of Artificial Sequence: Synthetic oligonucleotide
gggaggacgaugcggugcgacucgucacuccuccccagacgacucgcccga

SEQ ID NO: 4037 - RNA, 51 nt, Artificial Sequence
  Description of Artificial Sequence: Synthetic oligonucleotide
gggaggacgaugcggugcgacucgucacucguccccagacgacucgcccga

SEQ ID NO: 4038 - RNA, 51 nt, Artificial Sequence
  Description of Artificial Sequence: Synthetic oligonucleotide
gggaggacgaugcggugcguuucgucagcucuccccagacgacucgcccga

SEQ ID NO: 4039 - RNA, 51 nt, Artificial Sequence
  Description of Artificial Sequence: Synthetic oligonucleotide
gggaggacgaugcggugcguuucgucgauugccuccagacgacucgcccga

SEQ ID NO: 4040 - RNA, 51 nt, Artificial Sequence
  Description of Artificial Sequence: Synthetic oligonucleotide
gggaggacgaugcggugcugucgccuguucguccccagacgacucgcccga

SEQ ID NO: 4041 - RNA, 51 nt, Artificial Sequence
  Description of Artificial Sequence: Synthetic oligonucleotide
gggaggacgaugcggugcugucgucuguccguccccagacgacucgcccga

SEQ ID NO: 4042 - RNA, 50 nt, Artificial Sequence
  Description of Artificial Sequence: Synthetic oligonucleotide
gggaggacgaugcggugcugucgucugucguccccagacgacucgcccga

SEQ ID NO: 4043 - RNA, 51 nt, Artificial Sequence
  Description of Artificial Sequence: Synthetic oligonucleotide
gggaggacgaugcggugcugucgucuguucguacccagacgacucgcccga

SEQ ID NO: 4044 - RNA, 51 nt, Artificial Sequence
  Description of Artificial Sequence: Synthetic oligonucleotide
gggaggacgaugcggugcugucgucuguucguccacagacgacucgcccga

SEQ ID NO: 4045 - RNA, 51 nt, Artificial Sequence
  Description of Artificial Sequence: Synthetic oligonucleotide
gggaggacgaugcggugucgguugucugaucuccccagacgacucgcccga

SEQ ID NO: 4046 - RNA, 51 nt, Artificial Sequence
  Description of Artificial Sequence: Synthetic oligonucleotide
gggaggacgaugcggugucguagccuauccgcccgcagacgacucgcccga

SEQ ID NO: 4047 - RNA, 51 nt, Artificial Sequence
  Description of Artificial Sequence: Synthetic oligonucleotide
gggaggacgaugcggugucguucugguugucccgccagacgacucgcccga

SEQ ID NO: 4048 - RNA, 51 nt, Artificial Sequence
  Description of Artificial Sequence: Synthetic oligonucleotide
gggaggacgaugcggugucucgucugcgcucuccccagacgacucgcccga

SEQ ID NO: 4049 - RNA, 51 nt, Artificial Sequence
  Description of Artificial Sequence: Synthetic oligonucleotide
gggaggacgaugcgguucgucugcguuccuccggccagacgacucgcccga

SEQ ID NO: 4050 - RNA, 51 nt, Artificial Sequence
  Description of Artificial Sequence: Synthetic oligonucleotide
gggaggacgaugcgguucgucugguuuuggcgcgccagacgacucgcccga

SEQ ID NO: 4051 - RNA, 50 nt, Artificial Sequence
  Description of Artificial Sequence: Synthetic oligonucleotide
gggaggacgaugcgguucugucgucuguucgucccagacgacucgcccga

SEQ ID NO: 4052 - RNA, 50 nt, Artificial Sequence
  Description of Artificial Sequence: Synthetic oligonucleotide
gggaggacgaugcgguuugggguuuccccugccccagacgacucgcccga

SEQ ID NO: 4053 - RNA, 51 nt, Artificial Sequence
  Description of Artificial Sequence: Synthetic oligonucleotide
gggaggacgaugcgguuugggguuuucccguguuccagacgacucgcccga

SEQ ID NO: 4054 - RNA, 51 nt, Artificial Sequence
  Description of Artificial Sequence: Synthetic oligonucleotide
gggaggacgaugcgguuugggguuuuuucgugccccagacgacucgcccga

SEQ ID NO: 4055 - RNA, 51 nt, Artificial Sequence
  Description of Artificial Sequence: Synthetic oligonucleotide
gggaggacgaugcgguuuuggcuugucguuguccccagacgacucgcccga

SEQ ID NO: 4056 - RNA, 51 nt, Artificial Sequence
  Description of Artificial Sequence: Synthetic oligonucleotide
gggaggacgaugcggacucacacauucccggugugcagacgacucgcccga

SEQ ID NO: 4057 - RNA, 52 nt, Artificial Sequence
  Description of Artificial Sequence: Synthetic oligonucleotide
gggaggacgaugcggacugguguuuuguucccgcgccagacgacucgcccga

SEQ ID NO: 4058 - RNA, 51 nt, Artificial Sequence
  Description of Artificial Sequence: Synthetic oligonucleotide
gggaggacgaugcgggccuuucgucgaugacuccccagacgacucgcccga

SEQ ID NO: 4059 - RNA, 51 nt, Artificial Sequence
  Description of Artificial Sequence: Synthetic oligonucleotide
gggaggacgaugcgguaugggguuuucccgugccccagacgacucgcccga

SEQ ID NO: 4060 - RNA, 51 nt, Artificial Sequence
  Description of Artificial Sequence: Synthetic oligonucleotide
gggaggacgaugcgguauuguuuucugucguugugcagacgacucgcccga

SEQ ID NO: 4061 - RNA, 50 nt, Artificial Sequence
  Description of Artificial Sequence: Synthetic oligonucleotide
gggaggacgaugcgguccuggcuuguguuguccccagacgacucgcccga

SEQ ID NO: 4062 - RNA, 51 nt, Artificial Sequence
  Description of Artificial Sequence: Synthetic oligonucleotide
gggaggacgaugcggucugacguuuguucccgcgccagacgacucgcccga

SEQ ID NO: 4063 - RNA, 51 nt, Artificial Sequence
  Description of Artificial Sequence: Synthetic oligonucleotide
gggaggacgaugcggucuugugcuguuuguggcgccagacgacucgcccga

SEQ ID NO: 4064 - RNA, 51 nt, Artificial Sequence
  Description of Artificial Sequence: Synthetic oligonucleotide
gggaggacgaugcgguuuggcguuuucccgugccccagacgacucgcccga

SEQ ID NO: 4065 - RNA, 51 nt, Artificial Sequence
  Description of Artificial Sequence: Synthetic oligonucleotide
gggaggacgaugcgguuugggcuuuucccgugccccagacgacucgcccga

SEQ ID NO: 4066 - RNA, 52 nt, Artificial Sequence
  Description of Artificial Sequence: Synthetic oligonucleotide
gggaggacgaugcgguuugggguuuaucccgugccccagacgacucgcccga

SEQ ID NO: 4067 - RNA, 51 nt, Artificial Sequence
  Description of Artificial Sequence: Synthetic oligonucleotide
gggaggacgaugcgguuugggguuucucucggccccagacgacucgcccga

SEQ ID NO: 4068 - RNA, 51 nt, Artificial Sequence
  Description of Artificial Sequence: Synthetic oligonucleotide
gggaggacgaugcgguuugggguuugucccugccccagacgacucgcccga

SEQ ID NO: 4069 - RNA, 51 nt, Artificial Sequence
  Description of Artificial Sequence: Synthetic oligonucleotide
gggaggacgaugcgguuugggguuuucacccgccccagacgacucgcccga

SEQ ID NO: 4070 - RNA, 51 nt, Artificial Sequence
  Description of Artificial Sequence: Synthetic oligonucleotide
gggaggacgaugcgguuugggguuuucccgagccccagacgacucgcccga

SEQ ID NO: 4071 - RNA, 51 nt, Artificial Sequence
  Description of Artificial Sequence: Synthetic oligonucleotide
gggaggacgaugcgguuugggguuuucccgugcaccagacgacucgcccga

SEQ ID NO: 4072 - RNA, 52 nt, Artificial Sequence
  Description of Artificial Sequence: Synthetic oligonucleotide
gggaggacgaugcgguuuguugugcuugauaugccccagacgacucgcccga

SEQ ID NO: 4073 - RNA, 51 nt, Artificial Sequence
  Description of Artificial Sequence: Synthetic oligonucleotide
gggaggacgaugcggcaaugcuuacgugcacgcgccagacgacucgcccga

SEQ ID NO: 4074 - RNA, 51 nt, Artificial Sequence
  Description of Artificial Sequence: Synthetic oligonucleotide
gggaggacgaugcggcuugcgauauucccggucgccagacgacucgcccga

SEQ ID NO: 4075 - RNA, 50 nt, Artificial Sequence
  Description of Artificial Sequence: Synthetic oligonucleotide
gggaggacgaugcgguuugggguacuucccgccccagacgacucgcccga

SEQ ID NO: 4076 - RNA, 51 nt, Artificial Sequence
  Description of Artificial Sequence: Synthetic oligonucleotide
gggaggacgaugcgguuugggguguuuccccgccccagacgacucgcccga

SEQ ID NO: 4077 - RNA, 51 nt, Artificial Sequence
  Description of Artificial Sequence: Synthetic oligonucleotide
gggaggacgaugcgguuugggguuuuugcccgccccagacgacucgcccga

SEQ ID NO: 4078 - RNA, 51 nt, Artificial Sequence
  Description of Artificial Sequence: Synthetic oligonucleotide
gggaggacgaugcggaacauugggggggguguucccagacgacucgcccga

SEQ ID NO: 4079 - RNA, 51 nt, Artificial Sequence
  Description of Artificial Sequence: Synthetic oligonucleotide
gggaggacgaugcggacaugacgucuguucguccccagacgacucgcccga

SEQ ID NO: 4080 - RNA, 51 nt, Artificial Sequence
  Description of Artificial Sequence: Synthetic oligonucleotide
gggaggacgaugcggaccugaucgucugagcuccccagacgacucgcccga

SEQ ID NO: 4081 - RNA, 51 nt, Artificial Sequence
  Description of Artificial Sequence: Synthetic oligonucleotide
gggaggacgaugcggaccuguaguauguucguccccagacgacucgcccga

SEQ ID NO: 4082 - RNA, 51 nt, Artificial Sequence
  Description of Artificial Sequence: Synthetic oligonucleotide
gggaggacgaugcggaccuguagucuguucgucaccagacgacucgcccga

SEQ ID NO: 4083 - RNA, 51 nt, Artificial Sequence
  Description of Artificial Sequence: Synthetic oligonucleotide
gggaggacgaugcggaccuguagucuguucguccacagacgacucgcccga

SEQ ID NO: 4084 - RNA, 51 nt, Artificial Sequence
  Description of Artificial Sequence: Synthetic oligonucleotide
gggaggacgaugcggaccugucgucuguuagucaccagacgacucgcccga

SEQ ID NO: 4085 - RNA, 51 nt, Artificial Sequence
  Description of Artificial Sequence: Synthetic oligonucleotide
gggaggacgaugcggaccugucgucuguucguacacagacgacucgcccga

SEQ ID NO: 4086 - RNA, 51 nt, Artificial Sequence
  Description of Artificial Sequence: Synthetic oligonucleotide
gggaggacgaugcggacgacucgucuacaccuccccagacgacucgcccga

SEQ ID NO: 4087 - RNA, 51 nt, Artificial Sequence
  Description of Artificial Sequence: Synthetic oligonucleotide
gggaggacgaugcggacgacucgucucacgcuccccagacgacucgcccga

SEQ ID NO: 4088 - RNA, 51 nt, Artificial Sequence
  Description of Artificial Sequence: Synthetic oligonucleotide
gggaggacgaugcggacgaucuucuggcuccuccccagacgacucgcccga

SEQ ID NO: 4089 - RNA, 51 nt, Artificial Sequence
  Description of Artificial Sequence: Synthetic oligonucleotide
gggaggacgaugcggacgucucgucugugggccgccagacgacucgcccga

SEQ ID NO: 4090 - RNA, 51 nt, Artificial Sequence
  Description of Artificial Sequence: Synthetic oligonucleotide
gggaggacgaugcggagaguccgucuguuggccgccagacgacucgcccga

SEQ ID NO: 4091 - RNA, 51 nt, Artificial Sequence
  Description of Artificial Sequence: Synthetic oligonucleotide
gggaggacgaugcggagagucguucccuucguccccagacgacucgcccga

SEQ ID NO: 4092 - RNA, 51 nt, Artificial Sequence
  Description of Artificial Sequence: Synthetic oligonucleotide
gggaggacgaugcggaguuuccucugguucguccccagacgacucgcccga

SEQ ID NO: 4093 - RNA, 51 nt, Artificial Sequence
  Description of Artificial Sequence: Synthetic oligonucleotide
gggaggacgaugcggaugauuucgucuguacuccccagacgacucgcccga

SEQ ID NO: 4094 - RNA, 51 nt, Artificial Sequence
  Description of Artificial Sequence: Synthetic oligonucleotide
gggaggacgaugcggauuaaccucccuuccgcauccagacgacucgcccga

SEQ ID NO: 4095 - RNA, 51 nt, Artificial Sequence
  Description of Artificial Sequence: Synthetic oligonucleotide
gggaggacgaugcggcacgaguucgucucacuccccagacgacucgcccga

SEQ ID NO: 4096 - RNA, 51 nt, Artificial Sequence
  Description of Artificial Sequence: Synthetic oligonucleotide
gggaggacgaugcggcacguccuucacucccuccccagacgacucgcccga

SEQ ID NO: 4097 - RNA, 51 nt, Artificial Sequence
  Description of Artificial Sequence: Synthetic oligonucleotide
gggaggacgaugcggcagucgaucugauucuuccccagacgacucgcccga

SEQ ID NO: 4098 - RNA, 51 nt, Artificial Sequence
  Description of Artificial Sequence: Synthetic oligonucleotide
gggaggacgaugcggcagucggcuguuuuccgccccagacgacucgcccga

SEQ ID NO: 4099 - RNA, 51 nt, Artificial Sequence
  Description of Artificial Sequence: Synthetic oligonucleotide
gggaggacgaugcggcaugacuugcugcguugguccagacgacucgcccga

SEQ ID NO: 4100 - RNA, 51 nt, Artificial Sequence
  Description of Artificial Sequence: Synthetic oligonucleotide
gggaggacgaugcggcauguucgucugccccuccccagacgacucgcccga

SEQ ID NO: 4101 - RNA, 51 nt, Artificial Sequence
  Description of Artificial Sequence: Synthetic oligonucleotide
gggaggacgaugcggcauucgucugauuaccuccccagacgacucgcccga

SEQ ID NO: 4102 - RNA, 51 nt, Artificial Sequence
  Description of Artificial Sequence: Synthetic oligonucleotide
gggaggacgaugcggcauuucgucuguuggcgccccagacgacucgcccga

SEQ ID NO: 4103 - RNA, 51 nt, Artificial Sequence
  Description of Artificial Sequence: Synthetic oligonucleotide
gggaggacgaugcggccacucgucugcucacuccccagacgacucgcccga

SEQ ID NO: 4104 - RNA, 51 nt, Artificial Sequence
  Description of Artificial Sequence: Synthetic oligonucleotide
gggaggacgaugcggccacucuuccuuacccuccccagacgacucgcccga

SEQ ID NO: 4105 - RNA, 51 nt, Artificial Sequence
  Description of Artificial Sequence: Synthetic oligonucleotide
gggaggacgaugcggccagcucguucugugcuccccagacgacucgcccga

SEQ ID NO: 4106 - RNA, 51 nt, Artificial Sequence
  Description of Artificial Sequence: Synthetic oligonucleotide
gggaggacgaugcggccagucucugcuuaccuccccagacgacucgcccga

SEQ ID NO: 4107 - RNA, 51 nt, Artificial Sequence
  Description of Artificial Sequence: Synthetic oligonucleotide
gggaggacgaugcggccaguuguucuguguccccccagacgacucgcccga

SEQ ID NO: 4108 - RNA, 51 nt, Artificial Sequence
  Description of Artificial Sequence: Synthetic oligonucleotide
gggaggacgaugcggccauauccuccuucccuccccagacgacucgcccga

SEQ ID NO: 4109 - RNA, 51 nt, Artificial Sequence
  Description of Artificial Sequence: Synthetic oligonucleotide
gggaggacgaugcggccccauuuccuucucccccccagacgacucgcccga

SEQ ID NO: 4110 - RNA, 51 nt, Artificial Sequence
  Description of Artificial Sequence: Synthetic oligonucleotide
gggaggacgaugcggccccuucguccuuuccuccccagacgacucgcccga

SEQ ID NO: 4111 - RNA, 51 nt, Artificial Sequence
  Description of Artificial Sequence: Synthetic oligonucleotide
gggaggacgaugcggcccgucgucuguuauccccccagacgacucgcccga

SEQ ID NO: 4112 - RNA, 51 nt, Artificial Sequence
  Description of Artificial Sequence: Synthetic oligonucleotide
gggaggacgaugcggcccguugucugguacucccccagacgacucgcccga

SEQ ID NO: 4113 - RNA, 51 nt, Artificial Sequence
  Description of Artificial Sequence: Synthetic oligonucleotide
gggaggacgaugcggcccguugucuguuuccuccccagacgacucgcccga

SEQ ID NO: 4114 - RNA, 51 nt, Artificial Sequence
  Description of Artificial Sequence: Synthetic oligonucleotide
gggaggacgaugcggcccucgucugguuucguccccagacgacucgcccga

SEQ ID NO: 4115 - RNA, 51 nt, Artificial Sequence
  Description of Artificial Sequence: Synthetic oligonucleotide
gggaggacgaugcggcccugucgucgguucguccccagacgacucgcccga

SEQ ID NO: 4116 - RNA, 51 nt, Artificial Sequence
  Description of Artificial Sequence: Synthetic oligonucleotide
gggaggacgaugcggcccugucgucuggucguccccagacgacucgcccga

SEQ ID NO: 4117 - RNA, 51 nt, Artificial Sequence
  Description of Artificial Sequence: Synthetic oligonucleotide
gggaggacgaugcggcccugucgucugugcguccccagacgacucgcccga

SEQ ID NO: 4118 - RNA, 51 nt, Artificial Sequence
  Description of Artificial Sequence: Synthetic oligonucleotide
gggaggacgaugcggcccugucgucuguucgguuccagacgacucgcccga

SEQ ID NO: 4119 - RNA, 52 nt, Artificial Sequence
  Description of Artificial Sequence: Synthetic oligonucleotide
gggaggacgaugcggcccugucgucuguuucguccccagacgacucgcccga

SEQ ID NO: 4120 - RNA, 51 nt, Artificial Sequence
  Description of Artificial Sequence: Synthetic oligonucleotide
gggaggacgaugcggcccugucgucuguuucuccccagacgacucgcccga

SEQ ID NO: 4121 - RNA, 51 nt, Artificial Sequence
  Description of Artificial Sequence: Synthetic oligonucleotide
gggaggacgaugcggcccuguggucuguucguccccagacgacucgcccga

SEQ ID NO: 4122 - RNA, 51 nt, Artificial Sequence
  Description of Artificial Sequence: Synthetic oligonucleotide
gggaggacgaugcggcccuuucgucuguucugccccagacgacucgcccga

SEQ ID NO: 4123 - RNA, 51 nt, Artificial Sequence
  Description of Artificial Sequence: Synthetic oligonucleotide
gggaggacgaugcggccgaacucguuugcacuccccagacgacucgcccga

SEQ ID NO: 4124 - RNA, 51 nt, Artificial Sequence
  Description of Artificial Sequence: Synthetic oligonucleotide
gggaggacgaugcggccgaagucgucuacccuccccagacgacucgcccga

SEQ ID NO: 4125 - RNA, 51 nt, Artificial Sequence
  Description of Artificial Sequence: Synthetic oligonucleotide
gggaggacgaugcggccgacucucuguuuccaccccagacgacucgcccga

SEQ ID NO: 4126 - RNA, 51 nt, Artificial Sequence
  Description of Artificial Sequence: Synthetic oligonucleotide
gggaggacgaugcggccgagucugucuuucguccccagacgacucgcccga

SEQ ID NO: 4127 - RNA, 51 nt, Artificial Sequence
  Description of Artificial Sequence: Synthetic oligonucleotide
gggaggacgaugcggccgcaacguucaacucuccccagacgacucgcccga

SEQ ID NO: 4128 - RNA, 51 nt, Artificial Sequence
  Description of Artificial Sequence: Synthetic oligonucleotide
gggaggacgaugcggccgcaauccucuuuuguccccagacgacucgcccga

SEQ ID NO: 4129 - RNA, 51 nt, Artificial Sequence
  Description of Artificial Sequence: Synthetic oligonucleotide
gggaggacgaugcggccgcaccuauccucguaccccagacgacucgcccga

SEQ ID NO: 4130 - RNA, 51 nt, Artificial Sequence
  Description of Artificial Sequence: Synthetic oligonucleotide
gggaggacgaugcggccgcacguuuuuuccgcccccagacgacucgcccga

SEQ ID NO: 4131 - RNA, 51 nt, Artificial Sequence
  Description of Artificial Sequence: Synthetic oligonucleotide
gggaggacgaugcggccgcacuucacuccacuccccagacgacucgcccga

SEQ ID NO: 4132 - RNA, 51 nt, Artificial Sequence
  Description of Artificial Sequence: Synthetic oligonucleotide
gggaggacgaugcggccgcacuuccuugcucuccccagacgacucgcccga

SEQ ID NO: 4133 - RNA, 51 nt, Artificial Sequence
  Description of Artificial Sequence: Synthetic oligonucleotide
gggaggacgaugcggccgcaugcuucuccucuccccagacgacucgcccga

SEQ ID NO: 4134 - RNA, 51 nt, Artificial Sequence
  Description of Artificial Sequence: Synthetic oligonucleotide
gggaggacgaugcggccgcauuuccucacccuccccagacgacucgcccga

SEQ ID NO: 4135 - RNA, 51 nt, Artificial Sequence
  Description of Artificial Sequence: Synthetic oligonucleotide
gggaggacgaugcggccgccacgucuucuucuccccagacgacucgcccga

SEQ ID NO: 4136 - RNA, 51 nt, Artificial Sequence
  Description of Artificial Sequence: Synthetic oligonucleotide
gggaggacgaugcggccgccucuugaaaagucccccagacgacucgcccga

SEQ ID NO: 4137 - RNA, 51 nt, Artificial Sequence
  Description of Artificial Sequence: Synthetic oligonucleotide
gggaggacgaugcggccgcgaucucucuugucccccagacgacucgcccga

SEQ ID NO: 4138 - RNA, 51 nt, Artificial Sequence
  Description of Artificial Sequence: Synthetic oligonucleotide
gggaggacgaugcggccgcguccuuuuacccuccccagacgacucgcccga

SEQ ID NO: 4139 - RNA, 51 nt, Artificial Sequence
  Description of Artificial Sequence: Synthetic oligonucleotide
gggaggacgaugcggccgcguccuuuuguuacccccagacgacucgcccga

SEQ ID NO: 4140 - RNA, 51 nt, Artificial Sequence
  Description of Artificial Sequence: Synthetic oligonucleotide
gggaggacgaugcggccgcuacuucuuuccccccccagacgacucgcccga

SEQ ID NO: 4141 - RNA, 51 nt, Artificial Sequence
  Description of Artificial Sequence: Synthetic oligonucleotide
gggaggacgaugcggccggucgucucuaucguccccagacgacucgcccga

SEQ ID NO: 4142 - RNA, 51 nt, Artificial Sequence
  Description of Artificial Sequence: Synthetic oligonucleotide
gggaggacgaugcggccggucuucuguaaccuccccagacgacucgcccga

SEQ ID NO: 4143 - RNA, 51 nt, Artificial Sequence
  Description of Artificial Sequence: Synthetic oligonucleotide
gggaggacgaugcggccggucuucugucuccuccccagacgacucgcccga

SEQ ID NO: 4144 - RNA, 51 nt, Artificial Sequence
  Description of Artificial Sequence: Synthetic oligonucleotide
gggaggacgaugcggccguaguugucuuaccuccccagacgacucgcccga

SEQ ID NO: 4145 - RNA, 51 nt, Artificial Sequence
  Description of Artificial Sequence: Synthetic oligonucleotide
gggaggacgaugcggccgucaugucuuucccuccccagacgacucgcccga

SEQ ID NO: 4146 - RNA, 51 nt, Artificial Sequence
  Description of Artificial Sequence: Synthetic oligonucleotide
gggaggacgaugcggccgucucgucuuuuccuccccagacgacucgcccga

SEQ ID NO: 4147 - RNA, 51 nt, Artificial Sequence
  Description of Artificial Sequence: Synthetic oligonucleotide
gggaggacgaugcggccguguuguuugaugcuccccagacgacucgcccga

SEQ ID NO: 4148 - RNA, 51 nt, Artificial Sequence
  Description of Artificial Sequence: Synthetic oligonucleotide
gggaggacgaugcggccuaagaucuucccccuccccagacgacucgcccga

SEQ ID NO: 4149 - RNA, 51 nt, Artificial Sequence
  Description of Artificial Sequence: Synthetic oligonucleotide
gggaggacgaugcggccuaguccuccggcagucugcagacgacucgcccga

SEQ ID NO: 4150 - RNA, 51 nt, Artificial Sequence
  Description of Artificial Sequence: Synthetic oligonucleotide
gggaggacgaugcggccuaguucgucugaccuccccagacgacucgcccga

SEQ ID NO: 4151 - RNA, 51 nt, Artificial Sequence
  Description of Artificial Sequence: Synthetic oligonucleotide
gggaggacgaugcggccucgucugauuucucuccccagacgacucgcccga

SEQ ID NO: 4152 - RNA, 51 nt, Artificial Sequence
  Description of Artificial Sequence: Synthetic oligonucleotide
gggaggacgaugcggccucuuucgucugaccuccccagacgacucgcccga

SEQ ID NO: 4153 - RNA, 50 nt, Artificial Sequence
  Description of Artificial Sequence: Synthetic oligonucleotide
gggaggacgaugcggccugccgucuguucguccccagacgacucgcccga

SEQ ID NO: 4154 - RNA, 51 nt, Artificial Sequence
  Description of Artificial Sequence: Synthetic oligonucleotide
gggaggacgaugcggccugucgucucaaacguccccagacgacucgcccga

SEQ ID NO: 4155 - RNA, 50 nt, Artificial Sequence
  Description of Artificial Sequence: Synthetic oligonucleotide
gggaggacgaugcggccugucgucuguucguccucagacgacucgcccga

SEQ ID NO: 4156 - RNA, 50 nt, Artificial Sequence
  Description of Artificial Sequence: Synthetic oligonucleotide
gggaggacgaugcggccugucgucuguucuuccccagacgacucgcccga

SEQ ID NO: 4157 - RNA, 51 nt, Artificial Sequence
  Description of Artificial Sequence: Synthetic oligonucleotide
gggaggacgaugcggccugucgucuuacgcguccccagacgacucgcccga

SEQ ID NO: 4158 - RNA, 51 nt, Artificial Sequence
  Description of Artificial Sequence: Synthetic oligonucleotide
gggaggacgaugcggccugucuucuguuagcuccccagacgacucgcccga

SEQ ID NO: 4159 - RNA, 51 nt, Artificial Sequence
  Description of Artificial Sequence: Synthetic oligonucleotide
gggaggacgaugcggccuguucgucuugcgcuccccagacgacucgcccga

SEQ ID NO: 4160 - RNA, 51 nt, Artificial Sequence
  Description of Artificial Sequence: Synthetic oligonucleotide
gggaggacgaugcggccuguugucuggcuccuccccagacgacucgcccga

SEQ ID NO: 4161 - RNA, 52 nt, Artificial Sequence
  Description of Artificial Sequence: Synthetic oligonucleotide
gggaggacgaugcggccuguugugcuugauaugccccagacgacucgcccga

SEQ ID NO: 4162 - RNA, 51 nt, Artificial Sequence
  Description of Artificial Sequence: Synthetic oligonucleotide
gggaggacgaugcggccuucgucugauuccuuccccagacgacucgcccga

SEQ ID NO: 4163 - RNA, 51 nt, Artificial Sequence
  Description of Artificial Sequence: Synthetic oligonucleotide
gggaggacgaugcggccuucgucuguuaggcuccccagacgacucgcccga

SEQ ID NO: 4164 - RNA, 51 nt, Artificial Sequence
  Description of Artificial Sequence: Synthetic oligonucleotide
gggaggacgaugcggccuuucgucuggucuccccccagacgacucgcccga

SEQ ID NO: 4165 - RNA, 51 nt, Artificial Sequence
  Description of Artificial Sequence: Synthetic oligonucleotide
gggaggacgaugcggccuuucgucuggugcucccccagacgacucgcccga

SEQ ID NO: 4166 - RNA, 51 nt, Artificial Sequence
  Description of Artificial Sequence: Synthetic oligonucleotide
gggaggacgaugcggccuuucgucuguaagcuccccagacgacucgcccga

SEQ ID NO: 4167 - RNA, 51 nt, Artificial Sequence
  Description of Artificial Sequence: Synthetic oligonucleotide
gggaggacgaugcggccuuucgucuguagccuccgcagacgacucgcccga

SEQ ID NO: 4168 - RNA, 50 nt, Artificial Sequence
  Description of Artificial Sequence: Synthetic oligonucleotide
gggaggacgaugcggccuuucguucugaccuccccagacgacucgcccga

SEQ ID NO: 4169 - RNA, 51 nt, Artificial Sequence
  Description of Artificial Sequence: Synthetic oligonucleotide
gggaggacgaugcggcgaccccucuguucccuccccagacgacucgcccga

SEQ ID NO: 4170 - RNA, 51 nt, Artificial Sequence
  Description of Artificial Sequence: Synthetic oligonucleotide
gggaggacgaugcggcgaccucgucuugugucccccagacgacucgcccga

SEQ ID NO: 4171 - RNA, 51 nt, Artificial Sequence
  Description of Artificial Sequence: Synthetic oligonucleotide
gggaggacgaugcggcgacguugcucugcgcuccccagacgacucgcccga

SEQ ID NO: 4172 - RNA, 51 nt, Artificial Sequence
  Description of Artificial Sequence: Synthetic oligonucleotide
gggaggacgaugcggcgacuacucuggcuccuccccagacgacucgcccga

SEQ ID NO: 4173 - RNA, 51 nt, Artificial Sequence
  Description of Artificial Sequence: Synthetic oligonucleotide
gggaggacgaugcggcgacuccucaguucccuccccagacgacucgcccga

SEQ ID NO: 4174 - RNA, 51 nt, Artificial Sequence
  Description of Artificial Sequence: Synthetic oligonucleotide
gggaggacgaugcggcgacuccucugauccuuccccagacgacucgcccga

SEQ ID NO: 4175 - RNA, 51 nt, Artificial Sequence
  Description of Artificial Sequence: Synthetic oligonucleotide
gggaggacgaugcggcgacuccucugccuucuccccagacgacucgcccga

SEQ ID NO: 4176 - RNA, 48 nt, Artificial Sequence
  Description of Artificial Sequence: Synthetic oligonucleotide
gggaggacgaugcggcgacuccucuguucccccagacgacucgcccga

SEQ ID NO: 4177 - RNA, 51 nt, Artificial Sequence
  Description of Artificial Sequence: Synthetic oligonucleotide
gggaggacgaugcggcgacuccucuguuccucccccagacgacucgcccga

SEQ ID NO: 4178 - RNA, 51 nt, Artificial Sequence
  Description of Artificial Sequence: Synthetic oligonucleotide
gggaggacgaugcggcgacucggucuuuucguccccagacgacucgcccga

SEQ ID NO: 4179 - RNA, 51 nt, Artificial Sequence
  Description of Artificial Sequence: Synthetic oligonucleotide
gggaggacgaugcggcgacucguacugcucuuccccagacgacucgcccga

SEQ ID NO: 4180 - RNA, 51 nt, Artificial Sequence
  Description of Artificial Sequence: Synthetic oligonucleotide
gggaggacgaugcggcgacucgucaugcugucccccagacgacucgcccga

SEQ ID NO: 4181 - RNA, 51 nt, Artificial Sequence
  Description of Artificial Sequence: Synthetic oligonucleotide
gggaggacgaugcggcgacucucuggauucguccccagacgacucgcccga

SEQ ID NO: 4182 - RNA, 51 nt, Artificial Sequence
  Description of Artificial Sequence: Synthetic oligonucleotide
gggaggacgaugcggcgacuucgucugaaccuccccagacgacucgcccga

SEQ ID NO: 4183 - RNA, 51 nt, Artificial Sequence
  Description of Artificial Sequence: Synthetic oligonucleotide
gggaggacgaugcggcgagcucucuguuuucuccccagacgacucgcccga

SEQ ID NO: 4184 - RNA, 51 nt, Artificial Sequence
  Description of Artificial Sequence: Synthetic oligonucleotide
gggaggacgaugcggcgagcuucugacgccauccccagacgacucgcccga

SEQ ID NO: 4185 - RNA, 51 nt, Artificial Sequence
  Description of Artificial Sequence: Synthetic oligonucleotide
gggaggacgaugcggcgagcuucuguguuucuccccagacgacucgcccga

SEQ ID NO: 4186 - RNA, 51 nt, Artificial Sequence
  Description of Artificial Sequence: Synthetic oligonucleotide
gggaggacgaugcggcgaucgguucugacccuccccagacgacucgcccga

SEQ ID NO: 4187 - RNA, 51 nt, Artificial Sequence
  Description of Artificial Sequence: Synthetic oligonucleotide
gggaggacgaugcggcgaucuggguaccgcauccccagacgacucgcccga

SEQ ID NO: 4188 - RNA, 51 nt, Artificial Sequence
  Description of Artificial Sequence: Synthetic oligonucleotide
gggaggacgaugcggcgaucuucgucugcacuccccagacgacucgcccga

SEQ ID NO: 4189 - RNA, 51 nt, Artificial Sequence
  Description of Artificial Sequence: Synthetic oligonucleotide
gggaggacgaugcggcgaugucucugucccguccccagacgacucgcccga

SEQ ID NO: 4190 - RNA, 51 nt, Artificial Sequence
  Description of Artificial Sequence: Synthetic oligonucleotide
gggaggacgaugcggcgauuccucugaaucccccccagacgacucgcccga

SEQ ID NO: 4191 - RNA, 51 nt, Artificial Sequence
  Description of Artificial Sequence: Synthetic oligonucleotide
gggaggacgaugcggcgauucgaucuuuucguccccagacgacucgcccga

SEQ ID NO: 4192 - RNA, 51 nt, Artificial Sequence
  Description of Artificial Sequence: Synthetic oligonucleotide
gggaggacgaugcggcgauucguucuuaaccuccccagacgacucgcccga

SEQ ID NO: 4193 - RNA, 51 nt, Artificial Sequence
  Description of Artificial Sequence: Synthetic oligonucleotide
gggaggacgaugcggcgcaguucucuggaccuccccagacgacucgcccga

SEQ ID NO: 4194 - RNA, 51 nt, Artificial Sequence
  Description of Artificial Sequence: Synthetic oligonucleotide
gggaggacgaugcggcgccucguucugcgacuccccagacgacucgcccga

SEQ ID NO: 4195 - RNA, 51 nt, Artificial Sequence
  Description of Artificial Sequence: Synthetic oligonucleotide
gggaggacgaugcggcgccucucgucugagcuccccagacgacucgcccga

SEQ ID NO: 4196 - RNA, 51 nt, Artificial Sequence
  Description of Artificial Sequence: Synthetic oligonucleotide
gggaggacgaugcggcgccucucgucugcucuccccagacgacucgcccga

SEQ ID NO: 4197 - RNA, 51 nt, Artificial Sequence
  Description of Artificial Sequence: Synthetic oligonucleotide
gggaggacgaugcggcgccuuucgucugaccuccccagacgacucgcccga

SEQ ID NO: 4198 - RNA, 51 nt, Artificial Sequence
  Description of Artificial Sequence: Synthetic oligonucleotide
gggaggacgaugcggcgcgaauccucugcacuccccagacgacucgcccga

SEQ ID NO: 4199 - RNA, 51 nt, Artificial Sequence
  Description of Artificial Sequence: Synthetic oligonucleotide
gggaggacgaugcggcgcugucgucuguucguccccagacgacucgcccga

SEQ ID NO: 4200 - RNA, 51 nt, Artificial Sequence
  Description of Artificial Sequence: Synthetic oligonucleotide
gggaggacgaugcggcgcuucaacuggaccuuccccagacgacucgcccga

SEQ ID NO: 4201 - RNA, 51 nt, Artificial Sequence
  Description of Artificial Sequence: Synthetic oligonucleotide
gggaggacgaugcggcgcuucgaucuguucguccccagacgacucgcccga

SEQ ID NO: 4202 - RNA, 51 nt, Artificial Sequence
  Description of Artificial Sequence: Synthetic oligonucleotide
gggaggacgaugcggcgcuucuucuggacccuccccagacgacucgcccga

SEQ ID NO: 4203 - RNA, 51 nt, Artificial Sequence
  Description of Artificial Sequence: Synthetic oligonucleotide
gggaggacgaugcggcggcucgucugaaaccuccccagacgacucgcccga

SEQ ID NO: 4204 - RNA, 51 nt, Artificial Sequence
  Description of Artificial Sequence: Synthetic oligonucleotide
gggaggacgaugcggcggguccucuuucucguccccagacgacucgcccga

SEQ ID NO: 4205 - RNA, 51 nt, Artificial Sequence
  Description of Artificial Sequence: Synthetic oligonucleotide
gggaggacgaugcggcgguccucugauucccuccccagacgacucgcccga

SEQ ID NO: 4206 - RNA, 51 nt, Artificial Sequence
  Description of Artificial Sequence: Synthetic oligonucleotide
gggaggacgaugcggcgguccucuguucuccuccccagacgacucgcccga

SEQ ID NO: 4207 - RNA, 51 nt, Artificial Sequence
  Description of Artificial Sequence: Synthetic oligonucleotide
gggaggacgaugcggcggucgacgcugcguugguccagacgacucgcccga

SEQ ID NO: 4208 - RNA, 51 nt, Artificial Sequence
  Description of Artificial Sequence: Synthetic oligonucleotide
gggaggacgaugcggcggucuucuguaacgcuccccagacgacucgcccga

SEQ ID NO: 4209 - RNA, 51 nt, Artificial Sequence
  Description of Artificial Sequence: Synthetic oligonucleotide
gggaggacgaugcggcgguuccucugguucguccccagacgacucgcccga

SEQ ID NO: 4210 - RNA, 51 nt, Artificial Sequence
  Description of Artificial Sequence: Synthetic oligonucleotide
gggaggacgaugcggcguagucucugccugcuccccagacgacucgcccga

SEQ ID NO: 4211 - RNA, 51 nt, Artificial Sequence
  Description of Artificial Sequence: Synthetic oligonucleotide
gggaggacgaugcggcgucgucugucuuuccuccccagacgacucgcccga

SEQ ID NO: 4212 - RNA, 51 nt, Artificial Sequence
  Description of Artificial Sequence: Synthetic oligonucleotide
gggaggacgaugcggcgucucgucuugccccuccccagacgacucgcccga

SEQ ID NO: 4213 - RNA, 51 nt, Artificial Sequence
  Description of Artificial Sequence: Synthetic oligonucleotide
gggaggacgaugcggcgucucgucuuuccccuccccagacgacucgcccga

SEQ ID NO: 4214 - RNA, 51 nt, Artificial Sequence
  Description of Artificial Sequence: Synthetic oligonucleotide
gggaggacgaugcggcgucucguucuacugucccccagacgacucgcccga

SEQ ID NO: 4215 - RNA, 51 nt, Artificial Sequence
  Description of Artificial Sequence: Synthetic oligonucleotide
gggaggacgaugcggcgucucuucuggaaccuccccagacgacucgcccga

SEQ ID NO: 4216 - RNA, 51 nt, Artificial Sequence
  Description of Artificial Sequence: Synthetic oligonucleotide
gggaggacgaugcggcgugcucgucugcuccuccccagacgacucgcccga

SEQ ID NO: 4217 - RNA, 51 nt, Artificial Sequence
  Description of Artificial Sequence: Synthetic oligonucleotide
gggaggacgaugcggcgugcuucuggcuacucccccagacgacucgcccga

SEQ ID NO: 4218 - RNA, 51 nt, Artificial Sequence
  Description of Artificial Sequence: Synthetic oligonucleotide
gggaggacgaugcggcgugucguucuacuccuccccagacgacucgcccga

SEQ ID NO: 4219 - RNA, 50 nt, Artificial Sequence
  Description of Artificial Sequence: Synthetic oligonucleotide
gggaggacgaugcggcguuccucugguucguccccagacgacucgcccga

SEQ ID NO: 4220 - RNA, 51 nt, Artificial Sequence
  Description of Artificial Sequence: Synthetic oligonucleotide
gggaggacgaugcggcguucgucuguucucguccccagacgacucgcccga

SEQ ID NO: 4221 - RNA, 51 nt, Artificial Sequence
  Description of Artificial Sequence: Synthetic oligonucleotide
gggaggacgaugcggcguucguucuguugccuccacagacgacucgcccga

SEQ ID NO: 4222 - RNA, 51 nt, Artificial Sequence
  Description of Artificial Sequence: Synthetic oligonucleotide
gggaggacgaugcggcguucuucuggcucucccaccagacgacucgcccga

SEQ ID NO: 4223 - RNA, 51 nt, Artificial Sequence
  Description of Artificial Sequence: Synthetic oligonucleotide
gggaggacgaugcggcguuuccuaugguucguccccagacgacucgcccga

SEQ ID NO: 4224 - RNA, 51 nt, Artificial Sequence
  Description of Artificial Sequence: Synthetic oligonucleotide
gggaggacgaugcggcguuuccucagguucguccccagacgacucgcccga

SEQ ID NO: 4225 - RNA, 51 nt, Artificial Sequence
  Description of Artificial Sequence: Synthetic oligonucleotide
gggaggacgaugcggcguuuccucuggaucguccccagacgacucgcccga

SEQ ID NO: 4226 - RNA, 50 nt, Artificial Sequence
  Description of Artificial Sequence: Synthetic oligonucleotide
gggaggacgaugcggcguuuccucuggucguccccagacgacucgcccga

SEQ ID NO: 4227 - RNA, 51 nt, Artificial Sequence
  Description of Artificial Sequence: Synthetic oligonucleotide
gggaggacgaugcggcguuucguccuggaccuccccagacgacucgcccga

SEQ ID NO: 4228 - RNA, 51 nt, Artificial Sequence
  Description of Artificial Sequence: Synthetic oligonucleotide
gggaggacgaugcggcucagucguucugcgcuccccagacgacucgcccga

SEQ ID NO: 4229 - RNA, 51 nt, Artificial Sequence
  Description of Artificial Sequence: Synthetic oligonucleotide
gggaggacgaugcggcucccuauuccuucccuccccagacgacucgcccga

SEQ ID NO: 4230 - RNA, 51 nt, Artificial Sequence
  Description of Artificial Sequence: Synthetic oligonucleotide
gggaggacgaugcggcucgucuguucuucccuccccagacgacucgcccga

SEQ ID NO: 4231 - RNA, 51 nt, Artificial Sequence
  Description of Artificial Sequence: Synthetic oligonucleotide
gggaggacgaugcggcugaguuguucuggccuccccagacgacucgcccga

SEQ ID NO: 4232 - RNA, 51 nt, Artificial Sequence
  Description of Artificial Sequence: Synthetic oligonucleotide
gggaggacgaugcggcuggucgucuugaucguccccagacgacucgcccga

SEQ ID NO: 4233 - RNA, 51 nt, Artificial Sequence
  Description of Artificial Sequence: Synthetic oligonucleotide
gggaggacgaugcggcuucucgucugcugucuccccagacgacucgcccga

SEQ ID NO: 4234 - RNA, 51 nt, Artificial Sequence
  Description of Artificial Sequence: Synthetic oligonucleotide
gggaggacgaugcggcuucucgucuguuuccuccccagacgacucgcccga

SEQ ID NO: 4235 - RNA, 51 nt, Artificial Sequence
  Description of Artificial Sequence: Synthetic oligonucleotide
gggaggacgaugcggcuugucgaucugcucccccccagacgacucgcccga

SEQ ID NO: 4236 - RNA, 51 nt, Artificial Sequence
  Description of Artificial Sequence: Synthetic oligonucleotide
gggaggacgaugcggcuugucgucuagucccuccccagacgacucgcccga

SEQ ID NO: 4237 - RNA, 51 nt, Artificial Sequence
  Description of Artificial Sequence: Synthetic oligonucleotide
gggaggacgaugcggcuugucgucuuacucguccccagacgacucgcccga

SEQ ID NO: 4238 - RNA, 51 nt, Artificial Sequence
  Description of Artificial Sequence: Synthetic oligonucleotide
gggaggacgaugcggcuuguggucuguuaccuccccagacgacucgcccga

SEQ ID NO: 4239 - RNA, 51 nt, Artificial Sequence
  Description of Artificial Sequence: Synthetic oligonucleotide
gggaggacgaugcggcuuuucgucuguuucgucugcagacgacucgcccga

SEQ ID NO: 4240 - RNA, 51 nt, Artificial Sequence
  Description of Artificial Sequence: Synthetic oligonucleotide
gggaggacgaugcgggacagcgccugcaguacauucagacgacucgcccga

SEQ ID NO: 4241 - RNA, 51 nt, Artificial Sequence
  Description of Artificial Sequence: Synthetic oligonucleotide
gggaggacgaugcgggacucgucugaucaccuccccagacgacucgcccga

SEQ ID NO: 4242 - RNA, 49 nt, Artificial Sequence
  Description of Artificial Sequence: Synthetic oligonucleotide
gggaggacgaugcgggacuuauggggcucugugcagacgacucgcccga

SEQ ID NO: 4243 - RNA, 50 nt, Artificial Sequence
  Description of Artificial Sequence: Synthetic oligonucleotide
gggaggacgaugcgggauuguauggggcucugugcagacgacucgcccga

SEQ ID NO: 4244 - RNA, 51 nt, Artificial Sequence
  Description of Artificial Sequence: Synthetic oligonucleotide
gggaggacgaugcgggcaguuucgucacaccuccccagacgacucgcccga

SEQ ID NO: 4245 - RNA, 51 nt, Artificial Sequence
  Description of Artificial Sequence: Synthetic oligonucleotide
gggaggacgaugcgggccacucguuuguucguccccagacgacucgcccga

SEQ ID NO: 4246 - RNA, 50 nt, Artificial Sequence
  Description of Artificial Sequence: Synthetic oligonucleotide
gggaggacgaugcgggccagcguucuguacuccccagacgacucgcccga

SEQ ID NO: 4247 - RNA, 51 nt, Artificial Sequence
  Description of Artificial Sequence: Synthetic oligonucleotide
gggaggacgaugcgggccauucgucucuucguccccagacgacucgcccga

SEQ ID NO: 4248 - RNA, 50 nt, Artificial Sequence
  Description of Artificial Sequence: Synthetic oligonucleotide
gggaggacgaugcgggccauucgucuuucguccccagacgacucgcccga

SEQ ID NO: 4249 - RNA, 51 nt, Artificial Sequence
  Description of Artificial Sequence: Synthetic oligonucleotide
gggaggacgaugcgggcccagucguucuucguccccagacgacucgcccga

SEQ ID NO: 4250 - RNA, 51 nt, Artificial Sequence
  Description of Artificial Sequence: Synthetic oligonucleotide
gggaggacgaugcgggcccggucguucuuuguccccagacgacucgcccga

SEQ ID NO: 4251 - RNA, 51 nt, Artificial Sequence
  Description of Artificial Sequence: Synthetic oligonucleotide
gggaggacgaugcgggcccguccuuuuucccuccccagacgacucgcccga

SEQ ID NO: 4252 - RNA, 51 nt, Artificial Sequence
  Description of Artificial Sequence: Synthetic oligonucleotide
gggaggacgaugcgggcccucgucugacuucuccccagacgacucgcccga

SEQ ID NO: 4253 - RNA, 51 nt, Artificial Sequence
  Description of Artificial Sequence: Synthetic oligonucleotide
gggaggacgaugcgggcccucuucugguucguccccagacgacucgcccga

SEQ ID NO: 4254 - RNA, 52 nt, Artificial Sequence
  Description of Artificial Sequence: Synthetic oligonucleotide
gggaggacgaugcgggcccugucgucuguucgcccccagacgacucgcccga

SEQ ID NO: 4255 - RNA, 51 nt, Artificial Sequence
  Description of Artificial Sequence: Synthetic oligonucleotide
gggaggacgaugcgggcccuucgucuauuccuccccagacgacucgcccga

SEQ ID NO: 4256 - RNA, 51 nt, Artificial Sequence
  Description of Artificial Sequence: Synthetic oligonucleotide
gggaggacgaugcgggccuaucgucuuuacguccccagacgacucgcccga

SEQ ID NO: 4257 - RNA, 51 nt, Artificial Sequence
  Description of Artificial Sequence: Synthetic oligonucleotide
gggaggacgaugcgggccucagucguuucacuccccagacgacucgcccga

SEQ ID NO: 4258 - RNA, 51 nt, Artificial Sequence
  Description of Artificial Sequence: Synthetic oligonucleotide
gggaggacgaugcgggccucgucuguauuggccgccagacgacucgcccga

SEQ ID NO: 4259 - RNA, 48 nt, Artificial Sequence
  Description of Artificial Sequence: Synthetic oligonucleotide
gggaggacgaugcgggccucgucuguuguccccagacgacucgcccga

SEQ ID NO: 4260 - RNA, 51 nt, Artificial Sequence
  Description of Artificial Sequence: Synthetic oligonucleotide
gggaggacgaugcgggccucgucuuuugugucccccagacgacucgcccga

SEQ ID NO: 4261 - RNA, 51 nt, Artificial Sequence
  Description of Artificial Sequence: Synthetic oligonucleotide
gggaggacgaugcgggccucucgucuacuacuccccagacgacucgcccga

SEQ ID NO: 4262 - RNA, 51 nt, Artificial Sequence
  Description of Artificial Sequence: Synthetic oligonucleotide
gggaggacgaugcgggccucucgucuguucccccccagacgacucgcccga

SEQ ID NO: 4263 - RNA, 50 nt, Artificial Sequence
  Description of Artificial Sequence: Synthetic oligonucleotide
gggaggacgaugcgggccucucgucuguuguccccagacgacucgcccga

SEQ ID NO: 4264 - RNA, 51 nt, Artificial Sequence
  Description of Artificial Sequence: Synthetic oligonucleotide
gggaggacgaugcgggccucucgucuugcgcuccccagacgacucgcccga

SEQ ID NO: 4265 - RNA, 51 nt, Artificial Sequence
  Description of Artificial Sequence: Synthetic oligonucleotide
gggaggacgaugcgggccucugucgugcuucuccccagacgacucgcccga

SEQ ID NO: 4266 - RNA, 51 nt, Artificial Sequence
  Description of Artificial Sequence: Synthetic oligonucleotide
gggaggacgaugcgggccugcuucgucugucuccccagacgacucgcccga

SEQ ID NO: 4267 - RNA, 51 nt, Artificial Sequence
  Description of Artificial Sequence: Synthetic oligonucleotide
gggaggacgaugcgggccuguacgucucuccuccccagacgacucgcccga

SEQ ID NO: 4268 - RNA, 51 nt, Artificial Sequence
  Description of Artificial Sequence: Synthetic oligonucleotide
gggaggacgaugcgggccuguccucugaagcuccccagacgacucgcccga

SEQ ID NO: 4269 - RNA, 51 nt, Artificial Sequence
  Description of Artificial Sequence: Synthetic oligonucleotide
gggaggacgaugcgggccuguucucugcucuuccccagacgacucgcccga

SEQ ID NO: 4270 - RNA, 51 nt, Artificial Sequence
  Description of Artificial Sequence: Synthetic oligonucleotide
gggaggacgaugcgggccuguuucgucuuuguccucagacgacucgcccga

SEQ ID NO: 4271 - RNA, 51 nt, Artificial Sequence
  Description of Artificial Sequence: Synthetic oligonucleotide
gggaggacgaugcgggccuucgucuagagccuccccagacgacucgcccga

SEQ ID NO: 4272 - RNA, 51 nt, Artificial Sequence
  Description of Artificial Sequence: Synthetic oligonucleotide
gggaggacgaugcgggccuucgucuauuucguccccagacgacucgcccga

SEQ ID NO: 4273 - RNA, 50 nt, Artificial Sequence
  Description of Artificial Sequence: Synthetic oligonucleotide
gggaggacgaugcgggccuucucgucuguguccccagacgacucgcccga

SEQ ID NO: 4274 - RNA, 51 nt, Artificial Sequence
  Description of Artificial Sequence: Synthetic oligonucleotide
gggaggacgaugcgggccuucucgucuguugcccccagacgacucgcccga

SEQ ID NO: 4275 - RNA, 53 nt, Artificial Sequence
  Description of Artificial Sequence: Synthetic oligonucleotide
gggaggacgaugcgggccuucucgucuguugcccccccagacgacucgcccga

SEQ ID NO: 4276 - RNA, 51 nt, Artificial Sequence
  Description of Artificial Sequence: Synthetic oligonucleotide
gggaggacgaugcgggccuucucgucuguuguacccagacgacucgcccga

SEQ ID NO: 4277 - RNA, 51 nt, Artificial Sequence
  Description of Artificial Sequence: Synthetic oligonucleotide
gggaggacgaugcgggccuucucgucuugccuccccagacgacucgcccga

SEQ ID NO: 4278 - RNA, 49 nt, Artificial Sequence
  Description of Artificial Sequence: Synthetic oligonucleotide
gggaggacgaugcgggccuucucgucuuguccccagacgacucgcccga

SEQ ID NO: 4279 - RNA, 51 nt, Artificial Sequence
  Description of Artificial Sequence: Synthetic oligonucleotide
gggaggacgaugcgggccuucucgucuuuuguccccagacgacucgcccga

SEQ ID NO: 4280 - RNA, 51 nt, Artificial Sequence
  Description of Artificial Sequence: Synthetic oligonucleotide
gggaggacgaugcgggccuuucgucauggccuccccagacgacucgcccga

SEQ ID NO: 4281 - RNA, 51 nt, Artificial Sequence
  Description of Artificial Sequence: Synthetic oligonucleotide
gggaggacgaugcgggccuuucguccugaccuccccagacgacucgcccga

SEQ ID NO: 4282 - RNA, 51 nt, Artificial Sequence
  Description of Artificial Sequence: Synthetic oligonucleotide
gggaggacgaugcgggccuuucgucugcuucuccccagacgacucgcccga

SEQ ID NO: 4283 - RNA, 51 nt, Artificial Sequence
  Description of Artificial Sequence: Synthetic oligonucleotide
gggaggacgaugcgggccuuucguucugaccuacccagacgacucgcccga

SEQ ID NO: 4284 - RNA, 51 nt, Artificial Sequence
  Description of Artificial Sequence: Synthetic oligonucleotide
gggaggacgaugcgggccuuucguuuguuuguccccagacgacucgcccga

SEQ ID NO: 4285 - RNA, 51 nt, Artificial Sequence
  Description of Artificial Sequence: Synthetic oligonucleotide
gggaggacgaugcgggccuuucguuuugaccuccccagacgacucgcccga

SEQ ID NO: 4286 - RNA, 53 nt, Artificial Sequence
  Description of Artificial Sequence: Synthetic oligonucleotide
gggaggacgaugcgggccuuuucgucuguuguccccccagacgacucgcccga

SEQ ID NO: 4287 - RNA, 52 nt, Artificial Sequence
  Description of Artificial Sequence: Synthetic oligonucleotide
gggaggacgaugcgggccuuuucguucugaccuccccagacgacucgcccga

SEQ ID NO: 4288 - RNA, 51 nt, Artificial Sequence
  Description of Artificial Sequence: Synthetic oligonucleotide
gggaggacgaugcgggccuuuuguucugaccuccccagacgacucgcccga

SEQ ID NO: 4289 - RNA, 51 nt, Artificial Sequence
  Description of Artificial Sequence: Synthetic oligonucleotide
gggaggacgaugcgggcgacgcucugucucuuccccagacgacucgcccga

SEQ ID NO: 4290 - RNA, 51 nt, Artificial Sequence
  Description of Artificial Sequence: Synthetic oligonucleotide
gggaggacgaugcgggcgauuccucugucccuccccagacgacucgcccga

SEQ ID NO: 4291 - RNA, 51 nt, Artificial Sequence
  Description of Artificial Sequence: Synthetic oligonucleotide
gggaggacgaugcgggcgcuccucugcuucuuccccagacgacucgcccga

SEQ ID NO: 4292 - RNA, 51 nt, Artificial Sequence
  Description of Artificial Sequence: Synthetic oligonucleotide
gggaggacgaugcgggcggcucucuguuucguccccagacgacucgcccga

SEQ ID NO: 4293 - RNA, 51 nt, Artificial Sequence
  Description of Artificial Sequence: Synthetic oligonucleotide
gggaggacgaugcgggcgguuuuggggggacugugcagacgacucgcccga

SEQ ID NO: 4294 - RNA, 51 nt, Artificial Sequence
  Description of Artificial Sequence: Synthetic oligonucleotide
gggaggacgaugcgggcguauccucugcaacuccccagacgacucgcccga

SEQ ID NO: 4295 - RNA, 51 nt, Artificial Sequence
  Description of Artificial Sequence: Synthetic oligonucleotide
gggaggacgaugcgggcgucucguuuuccacuccccagacgacucgcccga

SEQ ID NO: 4296 - RNA, 51 nt, Artificial Sequence
  Description of Artificial Sequence: Synthetic oligonucleotide
gggaggacgaugcgggcgucuuacgucuuuguccccagacgacucgcccga

SEQ ID NO: 4297 - RNA, 51 nt, Artificial Sequence
  Description of Artificial Sequence: Synthetic oligonucleotide
gggaggacgaugcgggcguuaucgucucacguccccagacgacucgcccga

SEQ ID NO: 4298 - RNA, 51 nt, Artificial Sequence
  Description of Artificial Sequence: Synthetic oligonucleotide
gggaggacgaugcgggcguucgcuguuuccauccccagacgacucgcccga

SEQ ID NO: 4299 - RNA, 52 nt, Artificial Sequence
  Description of Artificial Sequence: Synthetic oligonucleotide
gggaggacgaugcgggcguucucgucgauugucccccagacgacucgcccga

SEQ ID NO: 4300 - RNA, 51 nt, Artificial Sequence
  Description of Artificial Sequence: Synthetic oligonucleotide
gggaggacgaugcgggcguuuacucuguucguccccagacgacucgcccga

SEQ ID NO: 4301 - RNA, 48 nt, Artificial Sequence
  Description of Artificial Sequence: Synthetic oligonucleotide
gggaggacgaugcgggcguuuccucuguuccccagacgacucgcccga

SEQ ID NO: 4302 - RNA, 51 nt, Artificial Sequence
  Description of Artificial Sequence: Synthetic oligonucleotide
gggaggacgaugcgggcguuuccucuguucguacccagacgacucgcccga

SEQ ID NO: 4303 - RNA, 51 nt, Artificial Sequence
  Description of Artificial Sequence: Synthetic oligonucleotide
gggaggacgaugcgggcguuuccucuguucgucaccagacgacucgcccga

SEQ ID NO: 4304 - RNA, 51 nt, Artificial Sequence
  Description of Artificial Sequence: Synthetic oligonucleotide
gggaggacgaugcgggcguuuccucuguucguccacagacgacucgcccga

SEQ ID NO: 4305 - RNA, 51 nt, Artificial Sequence
  Description of Artificial Sequence: Synthetic oligonucleotide
gggaggacgaugcgggcguuuccuuuguucguccccagacgacucgcccga

SEQ ID NO: 4306 - RNA, 51 nt, Artificial Sequence
  Description of Artificial Sequence: Synthetic oligonucleotide
gggaggacgaugcgggcguuucguuuucucguccccagacgacucgcccga

SEQ ID NO: 4307 - RNA, 50 nt, Artificial Sequence
  Description of Artificial Sequence: Synthetic oligonucleotide
gggaggacgaugcgggcguuucucuguucguccccagacgacucgcccga

SEQ ID NO: 4308 - RNA, 48 nt, Artificial Sequence
  Description of Artificial Sequence: Synthetic oligonucleotide
gggaggacgaugcgggcguuucuguucguccccagacgacucgcccga

SEQ ID NO: 4309 - RNA, 51 nt, Artificial Sequence
  Description of Artificial Sequence: Synthetic oligonucleotide
gggaggacgaugcgggcuauucguucuugcguccccagacgacucgcccga

SEQ ID NO: 4310 - RNA, 51 nt, Artificial Sequence
  Description of Artificial Sequence: Synthetic oligonucleotide
gggaggacgaugcgggcuauugcgucuguuguccccagacgacucgcccga

SEQ ID NO: 4311 - RNA, 51 nt, Artificial Sequence
  Description of Artificial Sequence: Synthetic oligonucleotide
gggaggacgaugcgggcuccugucgucauucuccccagacgacucgcccga

SEQ ID NO: 4312 - RNA, 51 nt, Artificial Sequence
  Description of Artificial Sequence: Synthetic oligonucleotide
gggaggacgaugcgggcucgucguuuuaucguccccagacgacucgcccga

SEQ ID NO: 4313 - RNA, 51 nt, Artificial Sequence
  Description of Artificial Sequence: Synthetic oligonucleotide
gggaggacgaugcgggcuguagucucugcgcuccccagacgacucgcccga

SEQ ID NO: 4314 - RNA, 51 nt, Artificial Sequence
  Description of Artificial Sequence: Synthetic oligonucleotide
gggaggacgaugcgggcuugucuccuguucguccccagacgacucgcccga

SEQ ID NO: 4315 - RNA, 51 nt, Artificial Sequence
  Description of Artificial Sequence: Synthetic oligonucleotide
gggaggacgaugcgggcuuguucucuguucguccccagacgacucgcccga

SEQ ID NO: 4316 - RNA, 51 nt, Artificial Sequence
  Description of Artificial Sequence: Synthetic oligonucleotide
gggaggacgaugcgggcuuguuuucuguucguccccagacgacucgcccga

SEQ ID NO: 4317 - RNA, 51 nt, Artificial Sequence
  Description of Artificial Sequence: Synthetic oligonucleotide
gggaggacgaugcgggcuuuccucuguacccuccccagacgacucgcccga

SEQ ID NO: 4318 - RNA, 51 nt, Artificial Sequence
  Description of Artificial Sequence: Synthetic oligonucleotide
gggaggacgaugcgggcuuuucgacugacgcuccccagacgacucgcccga

SEQ ID NO: 4319 - RNA, 51 nt, Artificial Sequence
  Description of Artificial Sequence: Synthetic oligonucleotide
gggaggacgaugcgggcuuuucgucuuugcguccccagacgacucgcccga

SEQ ID NO: 4320 - RNA, 48 nt, Artificial Sequence
  Description of Artificial Sequence: Synthetic oligonucleotide
gggaggacgaugcgggggguuuucccgugccccagacgacucgcccga

SEQ ID NO: 4321 - RNA, 51 nt, Artificial Sequence
  Description of Artificial Sequence: Synthetic oligonucleotide
gggaggacgaugcgggguaguucgucugcgcuccccagacgacucgcccga

SEQ ID NO: 4322 - RNA, 51 nt, Artificial Sequence
  Description of Artificial Sequence: Synthetic oligonucleotide
gggaggacgaugcggguagaucgucuuacccuccccagacgacucgcccga

SEQ ID NO: 4323 - RNA, 51 nt, Artificial Sequence
  Description of Artificial Sequence: Synthetic oligonucleotide
gggaggacgaugcggguagauucgucucgcguccccagacgacucgcccga

SEQ ID NO: 4324 - RNA, 51 nt, Artificial Sequence
  Description of Artificial Sequence: Synthetic oligonucleotide
gggaggacgaugcggguagucguccuguuggccgccagacgacucgcccga

SEQ ID NO: 4325 - RNA, 51 nt, Artificial Sequence
  Description of Artificial Sequence: Synthetic oligonucleotide
gggaggacgaugcggguauagucucugaugcuccccagacgacucgcccga

SEQ ID NO: 4326 - RNA, 51 nt, Artificial Sequence
  Description of Artificial Sequence: Synthetic oligonucleotide
gggaggacgaugcggguauccucgucuguggccgccagacgacucgcccga

SEQ ID NO: 4327 - RNA, 51 nt, Artificial Sequence
  Description of Artificial Sequence: Synthetic oligonucleotide
gggaggacgaugcgggucacucgucugcaccuccccagacgacucgcccga

SEQ ID NO: 4328 - RNA, 52 nt, Artificial Sequence
  Description of Artificial Sequence: Synthetic oligonucleotide
gggaggacgaugcggguccagucgucuguucguccccagacgacucgcccga

SEQ ID NO: 4329 - RNA, 51 nt, Artificial Sequence
  Description of Artificial Sequence: Synthetic oligonucleotide
gggaggacgaugcggguccgagcuucuguggccgccagacgacucgcccga

SEQ ID NO: 4330 - RNA, 52 nt, Artificial Sequence
  Description of Artificial Sequence: Synthetic oligonucleotide
gggaggacgaugcggguccuggcgucuguucguccccagacgacucgcccga

SEQ ID NO: 4331 - RNA, 51 nt, Artificial Sequence
  Description of Artificial Sequence: Synthetic oligonucleotide
gggaggacgaugcggguccugucgucugcuguccccagacgacucgcccga

SEQ ID NO: 4332 - RNA, 52 nt, Artificial Sequence
  Description of Artificial Sequence: Synthetic oligonucleotide
gggaggacgaugcggguccugucgucuguuagaccccagacgacucgcccga

SEQ ID NO: 4333 - RNA, 52 nt, Artificial Sequence
  Description of Artificial Sequence: Synthetic oligonucleotide
gggaggacgaugcggguccugucgucuguucgguuccagacgacucgcccga

SEQ ID NO: 4334 - RNA, 50 nt, Artificial Sequence
  Description of Artificial Sequence: Synthetic oligonucleotide
gggaggacgaugcggguccugucgucuguucguccagacgacucgcccga

SEQ ID NO: 4335 - RNA, 52 nt, Artificial Sequence
  Description of Artificial Sequence: Synthetic oligonucleotide
gggaggacgaugcggguccugucgucuguucgucaacagacgacucgcccga

SEQ ID NO: 4336 - RNA, 51 nt, Artificial Sequence
  Description of Artificial Sequence: Synthetic oligonucleotide
gggaggacgaugcggguccugucgucuguucuccccagacgacucgcccga

SEQ ID NO: 4337 - RNA, 51 nt, Artificial Sequence
  Description of Artificial Sequence: Synthetic oligonucleotide
gggaggacgaugcggguccuucgucuguucguccccagacgacucgcccga

SEQ ID NO: 4338 - RNA, 51 nt, Artificial Sequence
  Description of Artificial Sequence: Synthetic oligonucleotide
gggaggacgaugcggguccuuucugguuccugccccagacgacucgcccga

SEQ ID NO: 4339 - RNA, 51 nt, Artificial Sequence
  Description of Artificial Sequence: Synthetic oligonucleotide
gggaggacgaugcgggucgucucucaguccguccccagacgacucgcccga

SEQ ID NO: 4340 - RNA, 51 nt, Artificial Sequence
  Description of Artificial Sequence: Synthetic oligonucleotide
gggaggacgaugcgggucguugguaagcuccuccccagacgacucgcccga

SEQ ID NO: 4341 - RNA, 51 nt, Artificial Sequence
  Description of Artificial Sequence: Synthetic oligonucleotide
gggaggacgaugcgggucguuugaugccuccuccccagacgacucgcccga

SEQ ID NO: 4342 - RNA, 51 nt, Artificial Sequence
  Description of Artificial Sequence: Synthetic oligonucleotide
gggaggacgaugcgggucucguucuuuucccuccccagacgacucgcccga

SEQ ID NO: 4343 - RNA, 51 nt, Artificial Sequence
  Description of Artificial Sequence: Synthetic oligonucleotide
gggaggacgaugcgggugaaucguuugauccuccccagacgacucgcccga

SEQ ID NO: 4344 - RNA, 51 nt, Artificial Sequence
  Description of Artificial Sequence: Synthetic oligonucleotide
gggaggacgaugcgggugacucguccuauccuccccagacgacucgcccga

SEQ ID NO: 4345 - RNA, 51 nt, Artificial Sequence
  Description of Artificial Sequence: Synthetic oligonucleotide
gggaggacgaugcgggugagccucuguagcguccccagacgacucgcccga

SEQ ID NO: 4346 - RNA, 51 nt, Artificial Sequence
  Description of Artificial Sequence: Synthetic oligonucleotide
gggaggacgaugcgggugauucgccugucacuccccagacgacucgcccga

SEQ ID NO: 4347 - RNA, 51 nt, Artificial Sequence
  Description of Artificial Sequence: Synthetic oligonucleotide
gggaggacgaugcgggugauucgccuguucuuccccagacgacucgcccga

SEQ ID NO: 4348 - RNA, 51 nt, Artificial Sequence
  Description of Artificial Sequence: Synthetic oligonucleotide
gggaggacgaugcgggugcguuggucugaccuccccagacgacucgcccga

SEQ ID NO: 4349 - RNA, 51 nt, Artificial Sequence
  Description of Artificial Sequence: Synthetic oligonucleotide
gggaggacgaugcgggugcucucgucuacacuccccagacgacucgcccga

SEQ ID NO: 4350 - RNA, 51 nt, Artificial Sequence
  Description of Artificial Sequence: Synthetic oligonucleotide
gggaggacgaugcgggugcuucguuuguucuuccccagacgacucgcccga

SEQ ID NO: 4351 - RNA, 51 nt, Artificial Sequence
  Description of Artificial Sequence: Synthetic oligonucleotide
gggaggacgaugcggguguagucguuccucguccccagacgacucgcccga

SEQ ID NO: 4352 - RNA, 52 nt, Artificial Sequence
  Description of Artificial Sequence: Synthetic oligonucleotide
gggaggacgaugcgggugucccucgucuguugccgccagacgacucgcccga

SEQ ID NO: 4353 - RNA, 51 nt, Artificial Sequence
  Description of Artificial Sequence: Synthetic oligonucleotide
gggaggacgaugcgggugucguucugaugggccgccagacgacucgcccga

SEQ ID NO: 4354 - RNA, 51 nt, Artificial Sequence
  Description of Artificial Sequence: Synthetic oligonucleotide
gggaggacgaugcgggugucguucuguugugccgccagacgacucgcccga

SEQ ID NO: 4355 - RNA, 51 nt, Artificial Sequence
  Description of Artificial Sequence: Synthetic oligonucleotide
gggaggacgaugcggguguuguucgucgccgccuccagacgacucgcccga

SEQ ID NO: 4356 - RNA, 51 nt, Artificial Sequence
  Description of Artificial Sequence: Synthetic oligonucleotide
gggaggacgaugcggguguuuccucuguucguccccagacgacucgcccga

SEQ ID NO: 4357 - RNA, 51 nt, Artificial Sequence
  Description of Artificial Sequence: Synthetic oligonucleotide
gggaggacgaugcggguuagucuucugucccuccccagacgacucgcccga

SEQ ID NO: 4358 - RNA, 50 nt, Artificial Sequence
  Description of Artificial Sequence: Synthetic oligonucleotide
gggaggacgaugcggguugucgucuguucguccccagacgacucgcccga

SEQ ID NO: 4359 - RNA, 51 nt, Artificial Sequence
  Description of Artificial Sequence: Synthetic oligonucleotide
gggaggacgaugcgguaagucguucccuucguccccagacgacucgcccga

SEQ ID NO: 4360 - RNA, 51 nt, Artificial Sequence
  Description of Artificial Sequence: Synthetic oligonucleotide
gggaggacgaugcgguaaugucguauguuaguccccagacgacucgcccga

SEQ ID NO: 4361 - RNA, 51 nt, Artificial Sequence
  Description of Artificial Sequence: Synthetic oligonucleotide
gggaggacgaugcgguacuggcuugucguuguccccagacgacucgcccga

SEQ ID NO: 4362 - RNA, 51 nt, Artificial Sequence
  Description of Artificial Sequence: Synthetic oligonucleotide
gggaggacgaugcgguacuguagucuguuaguccccagacgacucgcccga

SEQ ID NO: 4363 - RNA, 51 nt, Artificial Sequence
  Description of Artificial Sequence: Synthetic oligonucleotide
gggaggacgaugcgguacugucguuuguucguccccagacgacucgcccga

SEQ ID NO: 4364 - RNA, 51 nt, Artificial Sequence
  Description of Artificial Sequence: Synthetic oligonucleotide
gggaggacgaugcggucaagucgucuguucguccccagacgacucgcccga

SEQ ID NO: 4365 - RNA, 51 nt, Artificial Sequence
  Description of Artificial Sequence: Synthetic oligonucleotide
gggaggacgaugcggucaguucgucugauucuccccagacgacucgcccga

SEQ ID NO: 4366 - RNA, 51 nt, Artificial Sequence
  Description of Artificial Sequence: Synthetic oligonucleotide
gggaggacgaugcggucaguugucuguggugccgccagacgacucgcccga

SEQ ID NO: 4367 - RNA, 51 nt, Artificial Sequence
  Description of Artificial Sequence: Synthetic oligonucleotide
gggaggacgaugcggucaugucaucuguucguccccagacgacucgcccga

SEQ ID NO: 4368 - RNA, 51 nt, Artificial Sequence
  Description of Artificial Sequence: Synthetic oligonucleotide
gggaggacgaugcggucaugucguauguuagucaccagacgacucgcccga

SEQ ID NO: 4369 - RNA, 51 nt, Artificial Sequence
  Description of Artificial Sequence: Synthetic oligonucleotide
gggaggacgaugcggucaugucgucuguacguccccagacgacucgcccga

SEQ ID NO: 4370 - RNA, 51 nt, Artificial Sequence
  Description of Artificial Sequence: Synthetic oligonucleotide
gggaggacgaugcggucaugucgucuguuaguccacagacgacucgcccga

SEQ ID NO: 4371 - RNA, 50 nt, Artificial Sequence
  Description of Artificial Sequence: Synthetic oligonucleotide
gggaggacgaugcggucaugucgucuguucgucccagacgacucgcccga

SEQ ID NO: 4372 - RNA, 51 nt, Artificial Sequence
  Description of Artificial Sequence: Synthetic oligonucleotide
gggaggacgaugcggucaugucgucuguucguccucagacgacucgcccga

SEQ ID NO: 4373 - RNA, 51 nt, Artificial Sequence
  Description of Artificial Sequence: Synthetic oligonucleotide
gggaggacgaugcggucaugucgucuguuuguccacagacgacucgcccga

SEQ ID NO: 4374 - RNA, 51 nt, Artificial Sequence
  Description of Artificial Sequence: Synthetic oligonucleotide
gggaggacgaugcgguccaaucgucuguucguccccagacgacucgcccga

SEQ ID NO: 4375 - RNA, 51 nt, Artificial Sequence
  Description of Artificial Sequence: Synthetic oligonucleotide
gggaggacgaugcgguccacguggcugcguugguccagacgacucgcccga

SEQ ID NO: 4376 - RNA, 51 nt, Artificial Sequence
  Description of Artificial Sequence: Synthetic oligonucleotide
gggaggacgaugcgguccagucguauguucguccccagacgacucgcccga

SEQ ID NO: 4377 - RNA, 51 nt, Artificial Sequence
  Description of Artificial Sequence: Synthetic oligonucleotide
gggaggacgaugcgguccagucgucuaugcguccccagacgacucgcccga

SEQ ID NO: 4378 - RNA, 51 nt, Artificial Sequence
  Description of Artificial Sequence: Synthetic oligonucleotide
gggaggacgaugcgguccagucgucugaucguacccagacgacucgcccga

SEQ ID NO: 4379 - RNA, 51 nt, Artificial Sequence
  Description of Artificial Sequence: Synthetic oligonucleotide
gggaggacgaugcgguccagucgucugcucguccccagacgacucgcccga

SEQ ID NO: 4380 - RNA, 51 nt, Artificial Sequence
  Description of Artificial Sequence: Synthetic oligonucleotide
gggaggacgaugcgguccagucgucuguucauccccagacgacucgcccga

SEQ ID NO: 4381 - RNA, 51 nt, Artificial Sequence
  Description of Artificial Sequence: Synthetic oligonucleotide
gggaggacgaugcgguccagucgucuguucgaccccagacgacucgcccga

SEQ ID NO: 4382 - RNA, 51 nt, Artificial Sequence
  Description of Artificial Sequence: Synthetic oligonucleotide
gggaggacgaugcgguccagucgucuguucgcccccagacgacucgcccga

SEQ ID NO: 4383 - RNA, 51 nt, Artificial Sequence
  Description of Artificial Sequence: Synthetic oligonucleotide
gggaggacgaugcgguccagucgucuguucguuuccagacgacucgcccga

SEQ ID NO: 4384 - RNA, 51 nt, Artificial Sequence
  Description of Artificial Sequence: Synthetic oligonucleotide
gggaggacgaugcgguccagucgucuguuuguccccagacgacucgcccga

SEQ ID NO: 4385 - RNA, 51 nt, Artificial Sequence
  Description of Artificial Sequence: Synthetic oligonucleotide
gggaggacgaugcgguccagucguucuguuggcgccagacgacucgcccga

SEQ ID NO: 4386 - RNA, 52 nt, Artificial Sequence
  Description of Artificial Sequence: Synthetic oligonucleotide
gggaggacgaugcgguccaugucgucuguucguccccagacgacucgcccga

SEQ ID NO: 4387 - RNA, 51 nt, Artificial Sequence
  Description of Artificial Sequence: Synthetic oligonucleotide
gggaggacgaugcggucccguccucuguucguccccagacgacucgcccga

SEQ ID NO: 4388 - RNA, 51 nt, Artificial Sequence
  Description of Artificial Sequence: Synthetic oligonucleotide
gggaggacgaugcggucccgucgucaguucguccccagacgacucgcccga

SEQ ID NO: 4389 - RNA, 51 nt, Artificial Sequence
  Description of Artificial Sequence: Synthetic oligonucleotide
gggaggacgaugcggucccgucgucuauucguccccagacgacucgcccga

SEQ ID NO: 4390 - RNA, 51 nt, Artificial Sequence
  Description of Artificial Sequence: Synthetic oligonucleotide
gggaggacgaugcggucccgucgucuguuaguccccagacgacucgcccga

SEQ ID NO: 4391 - RNA, 50 nt, Artificial Sequence
  Description of Artificial Sequence: Synthetic oligonucleotide
gggaggacgaugcggucccgucgucuguuguccccagacgacucgcccga

SEQ ID NO: 4392 - RNA, 51 nt, Artificial Sequence
  Description of Artificial Sequence: Synthetic oligonucleotide
gggaggacgaugcgguccuaucaucuguucguccccagacgacucgcccga

SEQ ID NO: 4393 - RNA, 51 nt, Artificial Sequence
  Description of Artificial Sequence: Synthetic oligonucleotide
gggaggacgaugcgguccuaucgucugaucguccccagacgacucgcccga

SEQ ID NO: 4394 - RNA, 51 nt, Artificial Sequence
  Description of Artificial Sequence: Synthetic oligonucleotide
gggaggacgaugcgguccuaucgucuguuaguccccagacgacucgcccga

SEQ ID NO: 4395 - RNA, 51 nt, Artificial Sequence
  Description of Artificial Sequence: Synthetic oligonucleotide
gggaggacgaugcgguccuaucgucuguucgucaccagacgacucgcccga

SEQ ID NO: 4396 - RNA, 51 nt, Artificial Sequence
  Description of Artificial Sequence: Synthetic oligonucleotide
gggaggacgaugcgguccuaucgucuguucguuuccagacgacucgcccga

SEQ ID NO: 4397 - RNA, 51 nt, Artificial Sequence
  Description of Artificial Sequence: Synthetic oligonucleotide
gggaggacgaugcgguccuaucguuuguucguccccagacgacucgcccga

SEQ ID NO: 4398 - RNA, 51 nt, Artificial Sequence
  Description of Artificial Sequence: Synthetic oligonucleotide
gggaggacgaugcgguccucccgucuguucguccccagacgacucgcccga

SEQ ID NO: 4399 - RNA, 51 nt, Artificial Sequence
  Description of Artificial Sequence: Synthetic oligonucleotide
gggaggacgaugcgguccucucgucuguucguccucagacgacucgcccga

SEQ ID NO: 4400 - RNA, 51 nt, Artificial Sequence
  Description of Artificial Sequence: Synthetic oligonucleotide
gggaggacgaugcgguccucucgucuguucguucccagacgacucgcccga

SEQ ID NO: 4401 - RNA, 51 nt, Artificial Sequence
  Description of Artificial Sequence: Synthetic oligonucleotide
gggaggacgaugcgguccucucuucuguucguccccagacgacucgcccga

SEQ ID NO: 4402 - RNA, 51 nt, Artificial Sequence
  Description of Artificial Sequence: Synthetic oligonucleotide
gggaggacgaugcgguccugacgucuguuaguccccagacgacucgcccga

SEQ ID NO: 4403 - RNA, 51 nt, Artificial Sequence
  Description of Artificial Sequence: Synthetic oligonucleotide
gggaggacgaugcgguccugacgucuguucgucaccagacgacucgcccga

SEQ ID NO: 4404 - RNA, 51 nt, Artificial Sequence
  Description of Artificial Sequence: Synthetic oligonucleotide
gggaggacgaugcgguccugccguauguucguccccagacgacucgcccga

SEQ ID NO: 4405 - RNA, 51 nt, Artificial Sequence
  Description of Artificial Sequence: Synthetic oligonucleotide
gggaggacgaugcgguccugccgucucuucguccccagacgacucgcccga

SEQ ID NO: 4406 - RNA, 51 nt, Artificial Sequence
  Description of Artificial Sequence: Synthetic oligonucleotide
gggaggacgaugcgguccugccgucuguucauccccagacgacucgcccga

SEQ ID NO: 4407 - RNA, 51 nt, Artificial Sequence
  Description of Artificial Sequence: Synthetic oligonucleotide
gggaggacgaugcgguccugccuucuguucguccccagacgacucgcccga

SEQ ID NO: 4408 - RNA, 51 nt, Artificial Sequence
  Description of Artificial Sequence: Synthetic oligonucleotide
gggaggacgaugcgguccuggcgccuguucguccccagacgacucgcccga

SEQ ID NO: 4409 - RNA, 51 nt, Artificial Sequence
  Description of Artificial Sequence: Synthetic oligonucleotide
gggaggacgaugcgguccuggcuuggcguuguccccagacgacucgcccga

SEQ ID NO: 4410 - RNA, 51 nt, Artificial Sequence
  Description of Artificial Sequence: Synthetic oligonucleotide
gggaggacgaugcgguccuggcuugucguaguccccagacgacucgcccga

SEQ ID NO: 4411 - RNA, 52 nt, Artificial Sequence
  Description of Artificial Sequence: Synthetic oligonucleotide
gggaggacgaugcgguccuggcuugucguuguuccccagacgacucgcccga

SEQ ID NO: 4412 - RNA, 51 nt, Artificial Sequence
  Description of Artificial Sequence: Synthetic oligonucleotide
gggaggacgaugcgguccuguaguauguucguacacagacgacucgcccga

SEQ ID NO: 4413 - RNA, 51 nt, Artificial Sequence
  Description of Artificial Sequence: Synthetic oligonucleotide
gggaggacgaugcgguccuguagucuguuaguaaccagacgacucgcccga

SEQ ID NO: 4414 - RNA, 51 nt, Artificial Sequence
  Description of Artificial Sequence: Synthetic oligonucleotide
gggaggacgaugcgguccuguagucuguuagucaacagacgacucgcccga

SEQ ID NO: 4415 - RNA, 51 nt, Artificial Sequence
  Description of Artificial Sequence: Synthetic oligonucleotide
gggaggacgaugcgguccuguagucuguuaguucccagacgacucgcccga

SEQ ID NO: 4416 - RNA, 51 nt, Artificial Sequence
  Description of Artificial Sequence: Synthetic oligonucleotide
gggaggacgaugcgguccuguagucuguucgcccccagacgacucgcccga

SEQ ID NO: 4417 - RNA, 51 nt, Artificial Sequence
  Description of Artificial Sequence: Synthetic oligonucleotide
gggaggacgaugcgguccuguagucuguucguccucagacgacucgcccga

SEQ ID NO: 4418 - RNA, 51 nt, Artificial Sequence
  Description of Artificial Sequence: Synthetic oligonucleotide
gggaggacgaugcgguccuguagucuguuuguacccagacgacucgcccga

SEQ ID NO: 4419 - RNA, 51 nt, Artificial Sequence
  Description of Artificial Sequence: Synthetic oligonucleotide
gggaggacgaugcgguccuguaguuuguucguacccagacgacucgcccga

SEQ ID NO: 4420 - RNA, 51 nt, Artificial Sequence
  Description of Artificial Sequence: Synthetic oligonucleotide
gggaggacgaugcgguccuguaguuuguuuguccccagacgacucgcccga

SEQ ID NO: 4421 - RNA, 51 nt, Artificial Sequence
  Description of Artificial Sequence: Synthetic oligonucleotide
gggaggacgaugcgguccugucaucuauucguccccagacgacucgcccga

SEQ ID NO: 4422 - RNA, 51 nt, Artificial Sequence
  Description of Artificial Sequence: Synthetic oligonucleotide
gggaggacgaugcgguccugucaucuguucgucaccagacgacucgcccga

SEQ ID NO: 4423 - RNA, 51 nt, Artificial Sequence
  Description of Artificial Sequence: Synthetic oligonucleotide
gggaggacgaugcgguccuguccucuguuccuccccagacgacucgcccga

SEQ ID NO: 4424 - RNA, 51 nt, Artificial Sequence
  Description of Artificial Sequence: Synthetic oligonucleotide
gggaggacgaugcgguccugucgacugaucguccccagacgacucgcccga

SEQ ID NO: 4425 - RNA, 51 nt, Artificial Sequence
  Description of Artificial Sequence: Synthetic oligonucleotide
gggaggacgaugcgguccugucgacuguucgcccccagacgacucgcccga

SEQ ID NO: 4426 - RNA, 51 nt, Artificial Sequence
  Description of Artificial Sequence: Synthetic oligonucleotide
gggaggacgaugcgguccugucgcauguucguccccagacgacucgcccga

SEQ ID NO: 4427 - RNA, 51 nt, Artificial Sequence
  Description of Artificial Sequence: Synthetic oligonucleotide
gggaggacgaugcgguccugucgccuauucguccccagacgacucgcccga

SEQ ID NO: 4428 - RNA, 51 nt, Artificial Sequence
  Description of Artificial Sequence: Synthetic oligonucleotide
gggaggacgaugcgguccugucgccucuucguccccagacgacucgcccga

SEQ ID NO: 4429 - RNA, 51 nt, Artificial Sequence
  Description of Artificial Sequence: Synthetic oligonucleotide
gggaggacgaugcgguccugucgccuguucguccucagacgacucgcccga

SEQ ID NO: 4430 - RNA, 50 nt, Artificial Sequence
  Description of Artificial Sequence: Synthetic oligonucleotide
gggaggacgaugcgguccugucgcuguucguccccagacgacucgcccga

SEQ ID NO: 4431 - RNA, 51 nt, Artificial Sequence
  Description of Artificial Sequence: Synthetic oligonucleotide
gggaggacgaugcgguccugucggcuguucgcccccagacgacucgcccga

SEQ ID NO: 4432 - RNA, 51 nt, Artificial Sequence
  Description of Artificial Sequence: Synthetic oligonucleotide
gggaggacgaugcgguccugucggcuguucguccacagacgacucgcccga

SEQ ID NO: 4433 - RNA, 51 nt, Artificial Sequence
  Description of Artificial Sequence: Synthetic oligonucleotide
gggaggacgaugcgguccugucguaugcucguccccagacgacucgcccga

SEQ ID NO: 4434 - RNA, 51 nt, Artificial Sequence
  Description of Artificial Sequence: Synthetic oligonucleotide
gggaggacgaugcgguccugucguauguucauccacagacgacucgcccga

SEQ ID NO: 4435 - RNA, 51 nt, Artificial Sequence
  Description of Artificial Sequence: Synthetic oligonucleotide
gggaggacgaugcgguccugucguauguucauccccagacgacucgcccga

SEQ ID NO: 4436 - RNA, 51 nt, Artificial Sequence
  Description of Artificial Sequence: Synthetic oligonucleotide
gggaggacgaugcgguccugucguauguucgcccccagacgacucgcccga

SEQ ID NO: 4437 - RNA, 51 nt, Artificial Sequence
  Description of Artificial Sequence: Synthetic oligonucleotide
gggaggacgaugcgguccugucguauguucggccccagacgacucgcccga

SEQ ID NO: 4438 - RNA, 51 nt, Artificial Sequence
  Description of Artificial Sequence: Synthetic oligonucleotide
gggaggacgaugcgguccugucguauguucguccucagacgacucgcccga

SEQ ID NO: 4439 - RNA, 51 nt, Artificial Sequence
  Description of Artificial Sequence: Synthetic oligonucleotide
gggaggacgaugcgguccugucguauguucgucgccagacgacucgcccga

SEQ ID NO: 4440 - RNA, 51 nt, Artificial Sequence
  Description of Artificial Sequence: Synthetic oligonucleotide
gggaggacgaugcgguccugucguauguucgugcccagacgacucgcccga

SEQ ID NO: 4441 - RNA, 51 nt, Artificial Sequence
  Description of Artificial Sequence: Synthetic oligonucleotide
gggaggacgaugcgguccugucguauuuucguacccagacgacucgcccga

SEQ ID NO: 4442 - RNA, 51 nt, Artificial Sequence
  Description of Artificial Sequence: Synthetic oligonucleotide
gggaggacgaugcgguccugucgucaguucgcccccagacgacucgcccga

SEQ ID NO: 4443 - RNA, 51 nt, Artificial Sequence
  Description of Artificial Sequence: Synthetic oligonucleotide
gggaggacgaugcgguccugucgucaguucguccucagacgacucgcccga

SEQ ID NO: 4444 - RNA, 51 nt, Artificial Sequence
  Description of Artificial Sequence: Synthetic oligonucleotide
gggaggacgaugcgguccugucgucccuucguccccagacgacucgcccga

SEQ ID NO: 4445 - RNA, 48 nt, Artificial Sequence
  Description of Artificial Sequence: Synthetic oligonucleotide
gggaggacgaugcgguccugucguccguuccccagacgacucgcccga

SEQ ID NO: 4446 - RNA, 51 nt, Artificial Sequence
  Description of Artificial Sequence: Synthetic oligonucleotide
gggaggacgaugcgguccugucguccguucguccacagacgacucgcccga

SEQ ID NO: 4447 - RNA, 50 nt, Artificial Sequence
  Description of Artificial Sequence: Synthetic oligonucleotide
gggaggacgaugcgguccugucgucggucguccccagacgacucgcccga

SEQ ID NO: 4448 - RNA, 51 nt, Artificial Sequence
  Description of Artificial Sequence: Synthetic oligonucleotide
gggaggacgaugcgguccugucgucgguucggccccagacgacucgcccga

SEQ ID NO: 4449 - RNA, 50 nt, Artificial Sequence
  Description of Artificial Sequence: Synthetic oligonucleotide
gggaggacgaugcgguccugucgucguucguuuccagacgacucgcccga

SEQ ID NO: 4450 - RNA, 51 nt, Artificial Sequence
  Description of Artificial Sequence: Synthetic oligonucleotide
gggaggacgaugcgguccugucgucuauuaguccccagacgacucgcccga

SEQ ID NO: 4451 - RNA, 51 nt, Artificial Sequence
  Description of Artificial Sequence: Synthetic oligonucleotide
gggaggacgaugcgguccugucgucuauucgucuccagacgacucgcccga

SEQ ID NO: 4452 - RNA, 50 nt, Artificial Sequence
  Description of Artificial Sequence: Synthetic oligonucleotide
gggaggacgaugcgguccugucgucuauuguccccagacgacucgcccga

SEQ ID NO: 4453 - RNA, 51 nt, Artificial Sequence
  Description of Artificial Sequence: Synthetic oligonucleotide
gggaggacgaugcgguccugucgucucuucguacccagacgacucgcccga

SEQ ID NO: 4454 - RNA, 51 nt, Artificial Sequence
  Description of Artificial Sequence: Synthetic oligonucleotide
gggaggacgaugcgguccugucgucucuucgucuccagacgacucgcccga

SEQ ID NO: 4455 - RNA, 50 nt, Artificial Sequence
  Description of Artificial Sequence: Synthetic oligonucleotide
gggaggacgaugcgguccugucgucucuuguccccagacgacucgcccga

SEQ ID NO: 4456 - RNA, 51 nt, Artificial Sequence
  Description of Artificial Sequence: Synthetic oligonucleotide
gggaggacgaugcgguccugucgucugauaguacacagacgacucgcccga

SEQ ID NO: 4457 - RNA, 51 nt, Artificial Sequence
  Description of Artificial Sequence: Synthetic oligonucleotide
gggaggacgaugcgguccugucgucugauaguccccagacgacucgcccga

SEQ ID NO: 4458 - RNA, 51 nt, Artificial Sequence
  Description of Artificial Sequence: Synthetic oligonucleotide
gggaggacgaugcgguccugucgucugaucgaacccagacgacucgcccga

SEQ ID NO: 4459 - RNA, 51 nt, Artificial Sequence
  Description of Artificial Sequence: Synthetic oligonucleotide
gggaggacgaugcgguccugucgucugaucgucuccagacgacucgcccga

SEQ ID NO: 4460 - RNA, 50 nt, Artificial Sequence
  Description of Artificial Sequence: Synthetic oligonucleotide
gggaggacgaugcgguccugucgucugccguccccagacgacucgcccga

SEQ ID NO: 4461 - RNA, 51 nt, Artificial Sequence
  Description of Artificial Sequence: Synthetic oligonucleotide
gggaggacgaugcgguccugucgucugcucguccacagacgacucgcccga

SEQ ID NO: 4462 - RNA, 51 nt, Artificial Sequence
  Description of Artificial Sequence: Synthetic oligonucleotide
gggaggacgaugcgguccugucgucugcucguccucagacgacucgcccga

SEQ ID NO: 4463 - RNA, 52 nt, Artificial Sequence
  Description of Artificial Sequence: Synthetic oligonucleotide
gggaggacgaugcgguccugucgucuguacccuccccagacgacucgcccga

SEQ ID NO: 4464 - RNA, 51 nt, Artificial Sequence
  Description of Artificial Sequence: Synthetic oligonucleotide
gggaggacgaugcgguccugucgucuguacguacccagacgacucgcccga

SEQ ID NO: 4465 - RNA, 51 nt, Artificial Sequence
  Description of Artificial Sequence: Synthetic oligonucleotide
gggaggacgaugcgguccugucgucuguacguccacagacgacucgcccga

SEQ ID NO: 4466 - RNA, 51 nt, Artificial Sequence
  Description of Artificial Sequence: Synthetic oligonucleotide
gggaggacgaugcgguccugucgucugucaguccccagacgacucgcccga

SEQ ID NO: 4467 - RNA, 50 nt, Artificial Sequence
  Description of Artificial Sequence: Synthetic oligonucleotide
gggaggacgaugcgguccugucgucugucauccccagacgacucgcccga

SEQ ID NO: 4468 - RNA, 48 nt, Artificial Sequence
  Description of Artificial Sequence: Synthetic oligonucleotide
gggaggacgaugcgguccugucgucugucccccagacgacucgcccga

SEQ ID NO: 4469 - RNA, 51 nt, Artificial Sequence
  Description of Artificial Sequence: Synthetic oligonucleotide
gggaggacgaugcgguccugucgucuguccguacccagacgacucgcccga

SEQ ID NO: 4470 - RNA, 49 nt, Artificial Sequence
  Description of Artificial Sequence: Synthetic oligonucleotide
gggaggacgaugcgguccugucgucugucuccccagacgacucgcccga

SEQ ID NO: 4471 - RNA, 51 nt, Artificial Sequence
  Description of Artificial Sequence: Synthetic oligonucleotide
gggaggacgaugcgguccugucgucuguuagaccccagacgacucgcccga

SEQ ID NO: 4472 - RNA, 51 nt, Artificial Sequence
  Description of Artificial Sequence: Synthetic oligonucleotide
gggaggacgaugcgguccugucgucuguuagcccccagacgacucgcccga

SEQ ID NO: 4473 - RNA, 50 nt, Artificial Sequence
  Description of Artificial Sequence: Synthetic oligonucleotide
gggaggacgaugcgguccugucgucuguuagucccagacgacucgcccga

SEQ ID NO: 4474 - RNA, 51 nt, Artificial Sequence
  Description of Artificial Sequence: Synthetic oligonucleotide
gggaggacgaugcgguccugucgucuguuaguuaccagacgacucgcccga

SEQ ID NO: 4475 - RNA, 51 nt, Artificial Sequence
  Description of Artificial Sequence: Synthetic oligonucleotide
gggaggacgaugcgguccugucgucuguuauuccccagacgacucgcccga

SEQ ID NO: 4476 - RNA, 51 nt, Artificial Sequence
  Description of Artificial Sequence: Synthetic oligonucleotide
gggaggacgaugcgguccugucgucuguucacccccagacgacucgcccga

SEQ ID NO: 4477 - RNA, 51 nt, Artificial Sequence
  Description of Artificial Sequence: Synthetic oligonucleotide
gggaggacgaugcgguccugucgucuguucauccucagacgacucgcccga

SEQ ID NO: 4478 - RNA, 51 nt, Artificial Sequence
  Description of Artificial Sequence: Synthetic oligonucleotide
gggaggacgaugcgguccugucgucuguuccgccccagacgacucgcccga

SEQ ID NO: 4479 - RNA, 50 nt, Artificial Sequence
  Description of Artificial Sequence: Synthetic oligonucleotide
gggaggacgaugcgguccugucgucuguuccucccagacgacucgcccga

SEQ ID NO: 4480 - RNA, 51 nt, Artificial Sequence
  Description of Artificial Sequence: Synthetic oligonucleotide
gggaggacgaugcgguccugucgucuguucgcccacagacgacucgcccga

SEQ ID NO: 4481 - RNA, 51 nt, Artificial Sequence
  Description of Artificial Sequence: Synthetic oligonucleotide
gggaggacgaugcgguccugucgucuguucggccacagacgacucgcccga

SEQ ID NO: 4482 - RNA, 51 nt, Artificial Sequence
  Description of Artificial Sequence: Synthetic oligonucleotide
gggaggacgaugcgguccugucgucuguucguagccagacgacucgcccga

SEQ ID NO: 4483 - RNA, 52 nt, Artificial Sequence
  Description of Artificial Sequence: Synthetic oligonucleotide
gggaggacgaugcgguccugucgucuguucgucacccagacgacucgcccga

SEQ ID NO: 4484 - RNA, 51 nt, Artificial Sequence
  Description of Artificial Sequence: Synthetic oligonucleotide
gggaggacgaugcgguccugucgucuguucguuuacagacgacucgcccga

SEQ ID NO: 4485 - RNA, 51 nt, Artificial Sequence
  Description of Artificial Sequence: Synthetic oligonucleotide
gggaggacgaugcgguccugucgucuguucuucuccagacgacucgcccga

SEQ ID NO: 4486 - RNA, 49 nt, Artificial Sequence
  Description of Artificial Sequence: Synthetic oligonucleotide
gggaggacgaugcgguccugucgucuguuguuccagacgacucgcccga

SEQ ID NO: 4487 - RNA, 52 nt, Artificial Sequence
  Description of Artificial Sequence: Synthetic oligonucleotide
gggaggacgaugcgguccugucgucuguuuccuccccagacgacucgcccga

SEQ ID NO: 4488 - RNA, 51 nt, Artificial Sequence
  Description of Artificial Sequence: Synthetic oligonucleotide
gggaggacgaugcgguccugucgucuguuucgucccagacgacucgcccga

SEQ ID NO: 4489 - RNA, 51 nt, Artificial Sequence
  Description of Artificial Sequence: Synthetic oligonucleotide
gggaggacgaugcgguccugucgucuguuuguacacagacgacucgcccga

SEQ ID NO: 4490 - RNA, 48 nt, Artificial Sequence
  Description of Artificial Sequence: Synthetic oligonucleotide
gggaggacgaugcgguccugucgucuucuccccagacgacucgcccga

SEQ ID NO: 4491 - RNA, 51 nt, Artificial Sequence
  Description of Artificial Sequence: Synthetic oligonucleotide
gggaggacgaugcgguccugucgucuuuccguccccagacgacucgcccga

SEQ ID NO: 4492 - RNA, 51 nt, Artificial Sequence
  Description of Artificial Sequence: Synthetic oligonucleotide
gggaggacgaugcgguccugucgucuuuucguccacagacgacucgcccga

SEQ ID NO: 4493 - RNA, 51 nt, Artificial Sequence
  Description of Artificial Sequence: Synthetic oligonucleotide
gggaggacgaugcgguccugucgucuuuucguuuccagacgacucgcccga

SEQ ID NO: 4494 - RNA, 52 nt, Artificial Sequence
  Description of Artificial Sequence: Synthetic oligonucleotide
gggaggacgaugcgguccugucgucuuuuucguccccagacgacucgcccga

SEQ ID NO: 4495 - RNA, 51 nt, Artificial Sequence
  Description of Artificial Sequence: Synthetic oligonucleotide
gggaggacgaugcgguccugucguguguucgucaccagacgacucgcccga

SEQ ID NO: 4496 - RNA, 51 nt, Artificial Sequence
  Description of Artificial Sequence: Synthetic oligonucleotide
gggaggacgaugcgguccugucguguguucgucuccagacgacucgcccga

SEQ ID NO: 4497 - RNA, 50 nt, Artificial Sequence
  Description of Artificial Sequence: Synthetic oligonucleotide
gggaggacgaugcgguccugucguuuguucgucccagacgacucgcccga

SEQ ID NO: 4498 - RNA, 51 nt, Artificial Sequence
  Description of Artificial Sequence: Synthetic oligonucleotide
gggaggacgaugcgguccugucguuuguucgugcccagacgacucgcccga

SEQ ID NO: 4499 - RNA, 51 nt, Artificial Sequence
  Description of Artificial Sequence: Synthetic oligonucleotide
gggaggacgaugcgguccugucuucuguucauccccagacgacucgcccga

SEQ ID NO: 4500 - RNA, 51 nt, Artificial Sequence
  Description of Artificial Sequence: Synthetic oligonucleotide
gggaggacgaugcgguccugucuucuguucgcccccagacgacucgcccga

SEQ ID NO: 4501 - RNA, 51 nt, Artificial Sequence
  Description of Artificial Sequence: Synthetic oligonucleotide
gggaggacgaugcgguccugucuucuguucuuccccagacgacucgcccga

SEQ ID NO: 4502 - RNA, 51 nt, Artificial Sequence
  Description of Artificial Sequence: Synthetic oligonucleotide
gggaggacgaugcgguccuguggucugcucguccccagacgacucgcccga

SEQ ID NO: 4503 - RNA, 51 nt, Artificial Sequence
  Description of Artificial Sequence: Synthetic oligonucleotide
gggaggacgaugcgguccuguggucuguucguccucagacgacucgcccga

SEQ ID NO: 4504 - RNA, 51 nt, Artificial Sequence
  Description of Artificial Sequence: Synthetic oligonucleotide
gggaggacgaugcgguccuguugucuguccguccccagacgacucgcccga

SEQ ID NO: 4505 - RNA, 50 nt, Artificial Sequence
  Description of Artificial Sequence: Synthetic oligonucleotide
gggaggacgaugcgguccuguugucugucguccccagacgacucgcccga

SEQ ID NO: 4506 - RNA, 51 nt, Artificial Sequence
  Description of Artificial Sequence: Synthetic oligonucleotide
gggaggacgaugcgguccuguugucuguucgcccccagacgacucgcccga

SEQ ID NO: 4507 - RNA, 51 nt, Artificial Sequence
  Description of Artificial Sequence: Synthetic oligonucleotide
gggaggacgaugcgguccuguugucuguucguuuccagacgacucgcccga

SEQ ID NO: 4508 - RNA, 51 nt, Artificial Sequence
  Description of Artificial Sequence: Synthetic oligonucleotide
gggaggacgaugcgguccuguugucuuuucguccccagacgacucgcccga

SEQ ID NO: 4509 - RNA, 51 nt, Artificial Sequence
  Description of Artificial Sequence: Synthetic oligonucleotide
gggaggacgaugcgguccuguuguguguucguccccagacgacucgcccga

SEQ ID NO: 4510 - RNA, 52 nt, Artificial Sequence
  Description of Artificial Sequence: Synthetic oligonucleotide
gggaggacgaugcgguccuugucgucuguucguccccagacgacucgcccga

SEQ ID NO: 4511 - RNA, 51 nt, Artificial Sequence
  Description of Artificial Sequence: Synthetic oligonucleotide
gggaggacgaugcgguccuuucguauguuaguccccagacgacucgcccga

SEQ ID NO: 4512 - RNA, 51 nt, Artificial Sequence
  Description of Artificial Sequence: Synthetic oligonucleotide
gggaggacgaugcgguccuuucgucuguuaguccccagacgacucgcccga

SEQ ID NO: 4513 - RNA, 51 nt, Artificial Sequence
  Description of Artificial Sequence: Synthetic oligonucleotide
gggaggacgaugcgguccuuucgucuguuccuccccagacgacucgcccga

SEQ ID NO: 4514 - RNA, 51 nt, Artificial Sequence
  Description of Artificial Sequence: Synthetic oligonucleotide
gggaggacgaugcgguccuuucgucuguucguccacagacgacucgcccga

SEQ ID NO: 4515 - RNA, 50 nt, Artificial Sequence
  Description of Artificial Sequence: Synthetic oligonucleotide
gggaggacgaugcggucgacgucugcuaucuccccagacgacucgcccga

SEQ ID NO: 4516 - RNA, 51 nt, Artificial Sequence
  Description of Artificial Sequence: Synthetic oligonucleotide
gggaggacgaugcggucgacgucugcuaucuuccccagacgacucgcccga

SEQ ID NO: 4517 - RNA, 51 nt, Artificial Sequence
  Description of Artificial Sequence: Synthetic oligonucleotide
gggaggacgaugcggucgacuucgucucaccuccccagacgacucgcccga

SEQ ID NO: 4518 - RNA, 51 nt, Artificial Sequence
  Description of Artificial Sequence: Synthetic oligonucleotide
gggaggacgaugcggucgagcgcuguuucccuccccagacgacucgcccga

SEQ ID NO: 4519 - RNA, 51 nt, Artificial Sequence
  Description of Artificial Sequence: Synthetic oligonucleotide
gggaggacgaugcggucgagucguucccucguccccagacgacucgcccga

SEQ ID NO: 4520 - RNA, 51 nt, Artificial Sequence
  Description of Artificial Sequence: Synthetic oligonucleotide
gggaggacgaugcggucgagugucugaucccuccccagacgacucgcccga

SEQ ID NO: 4521 - RNA, 51 nt, Artificial Sequence
  Description of Artificial Sequence: Synthetic oligonucleotide
gggaggacgaugcggucgaguucucuguagcuccccagacgacucgcccga

SEQ ID NO: 4522 - RNA, 51 nt, Artificial Sequence
  Description of Artificial Sequence: Synthetic oligonucleotide
gggaggacgaugcggucgauucucgucugugccgccagacgacucgcccga

SEQ ID NO: 4523 - RNA, 51 nt, Artificial Sequence
  Description of Artificial Sequence: Synthetic oligonucleotide
gggaggacgaugcggucggagucguucuaccuccccagacgacucgcccga

SEQ ID NO: 4524 - RNA, 51 nt, Artificial Sequence
  Description of Artificial Sequence: Synthetic oligonucleotide
gggaggacgaugcggucggagucguuuugccuccccagacgacucgcccga

SEQ ID NO: 4525 - RNA, 51 nt, Artificial Sequence
  Description of Artificial Sequence: Synthetic oligonucleotide
gggaggacgaugcggucggcucgucugcaacuccccagacgacucgcccga

SEQ ID NO: 4526 - RNA, 51 nt, Artificial Sequence
  Description of Artificial Sequence: Synthetic oligonucleotide
gggaggacgaugcggucgggucuucuuugcguccccagacgacucgcccga

SEQ ID NO: 4527 - RNA, 51 nt, Artificial Sequence
  Description of Artificial Sequence: Synthetic oligonucleotide
gggaggacgaugcggucggucgucuuuaacguccccagacgacucgcccga

SEQ ID NO: 4528 - RNA, 51 nt, Artificial Sequence
  Description of Artificial Sequence: Synthetic oligonucleotide
gggaggacgaugcggucgucucgucugcgcucccccagacgacucgcccga

SEQ ID NO: 4529 - RNA, 51 nt, Artificial Sequence
  Description of Artificial Sequence: Synthetic oligonucleotide
gggaggacgaugcggucgucucgucugcuccuccccagacgacucgcccga

SEQ ID NO: 4530 - RNA, 51 nt, Artificial Sequence
  Description of Artificial Sequence: Synthetic oligonucleotide
gggaggacgaugcggucgugucgucucuucguccccagacgacucgcccga

SEQ ID NO: 4531 - RNA, 51 nt, Artificial Sequence
  Description of Artificial Sequence: Synthetic oligonucleotide
gggaggacgaugcggucgugucuucuguucguccccagacgacucgcccga

SEQ ID NO: 4532 - RNA, 51 nt, Artificial Sequence
  Description of Artificial Sequence: Synthetic oligonucleotide
gggaggacgaugcggucguucgucugcugggccgccagacgacucgcccga

SEQ ID NO: 4533 - RNA, 51 nt, Artificial Sequence
  Description of Artificial Sequence: Synthetic oligonucleotide
gggaggacgaugcggucucaguaguaggccugcugcagacgacucgcccga

SEQ ID NO: 4534 - RNA, 51 nt, Artificial Sequence
  Description of Artificial Sequence: Synthetic oligonucleotide
gggaggacgaugcggucucaguagugggcuugcugcagacgacucgcccga

SEQ ID NO: 4535 - RNA, 51 nt, Artificial Sequence
  Description of Artificial Sequence: Synthetic oligonucleotide
gggaggacgaugcggucucaguggugggccugcugcagacgacucgcccga

SEQ ID NO: 4536 - RNA, 49 nt, Artificial Sequence
  Description of Artificial Sequence: Synthetic oligonucleotide
gggaggacgaugcggucucugggauuuccgccccagacgacucgcccga

SEQ ID NO: 4537 - RNA, 52 nt, Artificial Sequence
  Description of Artificial Sequence: Synthetic oligonucleotide
gggaggacgaugcggucugggguuuuucccgugccccagacgacucgcccga

SEQ ID NO: 4538 - RNA, 51 nt, Artificial Sequence
  Description of Artificial Sequence: Synthetic oligonucleotide
gggaggacgaugcggucuggucgucuguucguccccagacgacucgcccga

SEQ ID NO: 4539 - RNA, 50 nt, Artificial Sequence
  Description of Artificial Sequence: Synthetic oligonucleotide
gggaggacgaugcggucugucgucuguucggccccagacgacucgcccga

SEQ ID NO: 4540 - RNA, 50 nt, Artificial Sequence
  Description of Artificial Sequence: Synthetic oligonucleotide
gggaggacgaugcggucugucugggauguggccccagacgacucgcccga

SEQ ID NO: 4541 - RNA, 48 nt, Artificial Sequence
  Description of Artificial Sequence: Synthetic oligonucleotide
gggaggacgaugcggucugugggauguggccccagacgacucgcccga

SEQ ID NO: 4542 - RNA, 51 nt, Artificial Sequence
  Description of Artificial Sequence: Synthetic oligonucleotide
gggaggacgaugcggucuguggguauccuccgccccagacgacucgcccga

SEQ ID NO: 4543 - RNA, 50 nt, Artificial Sequence
  Description of Artificial Sequence: Synthetic oligonucleotide
gggaggacgaugcggucuguguggguuguggccccagacgacucgcccga

SEQ ID NO: 4544 - RNA, 52 nt, Artificial Sequence
  Description of Artificial Sequence: Synthetic oligonucleotide
gggaggacgaugcggucuguuguguuugauaugccccagacgacucgcccga

SEQ ID NO: 4545 - RNA, 51 nt, Artificial Sequence
  Description of Artificial Sequence: Synthetic oligonucleotide
gggaggacgaugcggucuuaguagugggccugcugcagacgacucgcccga

SEQ ID NO: 4546 - RNA, 51 nt, Artificial Sequence
  Description of Artificial Sequence: Synthetic oligonucleotide
gggaggacgaugcggucuucuggguauucccaccccagacgacucgcccga

SEQ ID NO: 4547 - RNA, 50 nt, Artificial Sequence
  Description of Artificial Sequence: Synthetic oligonucleotide
gggaggacgaugcggucuucuggguuugccgccccagacgacucgcccga

SEQ ID NO: 4548 - RNA, 51 nt, Artificial Sequence
  Description of Artificial Sequence: Synthetic oligonucleotide
gggaggacgaugcggucuucuggguuuuccugccccagacgacucgcccga

SEQ ID NO: 4549 - RNA, 51 nt, Artificial Sequence
  Description of Artificial Sequence: Synthetic oligonucleotide
gggaggacgaugcggucuucuggugugcuccccgccagacgacucgcccga

SEQ ID NO: 4550 - RNA, 49 nt, Artificial Sequence
  Description of Artificial Sequence: Synthetic oligonucleotide
gggaggacgaugcggucuugucgucuguucccccagacgacucgcccga

SEQ ID NO: 4551 - RNA, 51 nt, Artificial Sequence
  Description of Artificial Sequence: Synthetic oligonucleotide
gggaggacgaugcggucuugucgucuguucggccccagacgacucgcccga

SEQ ID NO: 4552 - RNA, 51 nt, Artificial Sequence
  Description of Artificial Sequence: Synthetic oligonucleotide
gggaggacgaugcggucuugucgucuguucguccgcagacgacucgcccga

SEQ ID NO: 4553 - RNA, 51 nt, Artificial Sequence
  Description of Artificial Sequence: Synthetic oligonucleotide
gggaggacgaugcggucuuguggucuguucguccccagacgacucgcccga

SEQ ID NO: 4554 - RNA, 51 nt, Artificial Sequence
  Description of Artificial Sequence: Synthetic oligonucleotide
gggaggacgaugcggugaacucguucugcgcuccccagacgacucgcccga

SEQ ID NO: 4555 - RNA, 51 nt, Artificial Sequence
  Description of Artificial Sequence: Synthetic oligonucleotide
gggaggacgaugcggugacucgucuguuucgucuccagacgacucgcccga

SEQ ID NO: 4556 - RNA, 51 nt, Artificial Sequence
  Description of Artificial Sequence: Synthetic oligonucleotide
gggaggacgaugcggugagccuucuguuaccuccccagacgacucgcccga

SEQ ID NO: 4557 - RNA, 51 nt, Artificial Sequence
  Description of Artificial Sequence: Synthetic oligonucleotide
gggaggacgaugcggugaggucugucuguggccgccagacgacucgcccga

SEQ ID NO: 4558 - RNA, 51 nt, Artificial Sequence
  Description of Artificial Sequence: Synthetic oligonucleotide
gggaggacgaugcggugagucguucccuccguccccagacgacucgcccga

SEQ ID NO: 4559 - RNA, 51 nt, Artificial Sequence
  Description of Artificial Sequence: Synthetic oligonucleotide
gggaggacgaugcggugagucguucccuucguccucagacgacucgcccga

SEQ ID NO: 4560 - RNA, 51 nt, Artificial Sequence
  Description of Artificial Sequence: Synthetic oligonucleotide
gggaggacgaugcggugagucguucccuucgucuccagacgacucgcccga

SEQ ID NO: 4561 - RNA, 51 nt, Artificial Sequence
  Description of Artificial Sequence: Synthetic oligonucleotide
gggaggacgaugcggugagucguucccuuuguccccagacgacucgcccga

SEQ ID NO: 4562 - RNA, 51 nt, Artificial Sequence
  Description of Artificial Sequence: Synthetic oligonucleotide
gggaggacgaugcggugaguugucuacugggccgccagacgacucgcccga

SEQ ID NO: 4563 - RNA, 51 nt, Artificial Sequence
  Description of Artificial Sequence: Synthetic oligonucleotide
gggaggacgaugcggugaucucgucugauggccgccagacgacucgcccga

SEQ ID NO: 4564 - RNA, 51 nt, Artificial Sequence
  Description of Artificial Sequence: Synthetic oligonucleotide
gggaggacgaugcggugauugucgccuguggccgccagacgacucgcccga

SEQ ID NO: 4565 - RNA, 51 nt, Artificial Sequence
  Description of Artificial Sequence: Synthetic oligonucleotide
gggaggacgaugcggugcaugucgucuaaccuccccagacgacucgcccga

SEQ ID NO: 4566 - RNA, 51 nt, Artificial Sequence
  Description of Artificial Sequence: Synthetic oligonucleotide
gggaggacgaugcggugcccgucgucuugcguccucagacgacucgcccga

SEQ ID NO: 4567 - RNA, 51 nt, Artificial Sequence
  Description of Artificial Sequence: Synthetic oligonucleotide
gggaggacgaugcggugccucgucugcuaccuccccagacgacucgcccga

SEQ ID NO: 4568 - RNA, 51 nt, Artificial Sequence
  Description of Artificial Sequence: Synthetic oligonucleotide
gggaggacgaugcggugccuucgucugucgcuccccagacgacucgcccga

SEQ ID NO: 4569 - RNA, 51 nt, Artificial Sequence
  Description of Artificial Sequence: Synthetic oligonucleotide
gggaggacgaugcggugcgauucgucccuccuccccagacgacucgcccga

SEQ ID NO: 4570 - RNA, 51 nt, Artificial Sequence
  Description of Artificial Sequence: Synthetic oligonucleotide
gggaggacgaugcggugcgauucgucgaugucccccagacgacucgcccga

SEQ ID NO: 4571 - RNA, 51 nt, Artificial Sequence
  Description of Artificial Sequence: Synthetic oligonucleotide
gggaggacgaugcggugcgugacgucucaccuccccagacgacucgcccga

SEQ ID NO: 4572 - RNA, 51 nt, Artificial Sequence
  Description of Artificial Sequence: Synthetic oligonucleotide
gggaggacgaugcggugcgugcucgucuaccuccccagacgacucgcccga

SEQ ID NO: 4573 - RNA, 51 nt, Artificial Sequence
  Description of Artificial Sequence: Synthetic oligonucleotide
gggaggacgaugcggugcguucgucuuacccuccccagacgacucgcccga

SEQ ID NO: 4574 - RNA, 51 nt, Artificial Sequence
  Description of Artificial Sequence: Synthetic oligonucleotide
gggaggacgaugcggugcucguugucuguugccgccagacgacucgcccga

SEQ ID NO: 4575 - RNA, 51 nt, Artificial Sequence
  Description of Artificial Sequence: Synthetic oligonucleotide
gggaggacgaugcggugcugucgucuguuaguccccagacgacucgcccga

SEQ ID NO: 4576 - RNA, 50 nt, Artificial Sequence
  Description of Artificial Sequence: Synthetic oligonucleotide
gggaggacgaugcggugcugucgucuguucuccccagacgacucgcccga

SEQ ID NO: 4577 - RNA, 51 nt, Artificial Sequence
  Description of Artificial Sequence: Synthetic oligonucleotide
gggaggacgaugcggugggucgucauauccguccccagacgacucgcccga

SEQ ID NO: 4578 - RNA, 51 nt, Artificial Sequence
  Description of Artificial Sequence: Synthetic oligonucleotide
gggaggacgaugcggugucauagucuauccgcccgcagacgacucgcccga

SEQ ID NO: 4579 - RNA, 51 nt, Artificial Sequence
  Description of Artificial Sequence: Synthetic oligonucleotide
gggaggacgaugcgguguccucauucccgccuccccagacgacucgcccga

SEQ ID NO: 4580 - RNA, 51 nt, Artificial Sequence
  Description of Artificial Sequence: Synthetic oligonucleotide
gggaggacgaugcggugucgggucgccuuuguccccagacgacucgcccga

SEQ ID NO: 4581 - RNA, 51 nt, Artificial Sequence
  Description of Artificial Sequence: Synthetic oligonucleotide
gggaggacgaugcgguguguuggucuguuccgccccagacgacucgcccga

SEQ ID NO: 4582 - RNA, 51 nt, Artificial Sequence
  Description of Artificial Sequence: Synthetic oligonucleotide
gggaggacgaugcgguguuguagucgucguggccgcagacgacucgcccga

SEQ ID NO: 4583 - RNA, 51 nt, Artificial Sequence
  Description of Artificial Sequence: Synthetic oligonucleotide
gggaggacgaugcgguguuguccgucugcgcuccccagacgacucgcccga

SEQ ID NO: 4584 - RNA, 51 nt, Artificial Sequence
  Description of Artificial Sequence: Synthetic oligonucleotide
gggaggacgaugcgguuagggggggacgcauuguccagacgacucgcccga

SEQ ID NO: 4585 - RNA, 51 nt, Artificial Sequence
  Description of Artificial Sequence: Synthetic oligonucleotide
gggaggacgaugcgguuagggguuuucccgugccccagacgacucgcccga

SEQ ID NO: 4586 - RNA, 51 nt, Artificial Sequence
  Description of Artificial Sequence: Synthetic oligonucleotide
gggaggacgaugcgguuccgucgucuguucguccccagacgacucgcccga

SEQ ID NO: 4587 - RNA, 51 nt, Artificial Sequence
  Description of Artificial Sequence: Synthetic oligonucleotide
gggaggacgaugcgguucugucgucugcucguccccagacgacucgcccga

SEQ ID NO: 4588 - RNA, 51 nt, Artificial Sequence
  Description of Artificial Sequence: Synthetic oligonucleotide
gggaggacgaugcgguucugucgucuguucgcccccagacgacucgcccga

SEQ ID NO: 4589 - RNA, 51 nt, Artificial Sequence
  Description of Artificial Sequence: Synthetic oligonucleotide
gggaggacgaugcgguucugucgucuguucgucaccagacgacucgcccga

SEQ ID NO: 4590 - RNA, 51 nt, Artificial Sequence
  Description of Artificial Sequence: Synthetic oligonucleotide
gggaggacgaugcgguucugucgucuuuucguccccagacgacucgcccga

SEQ ID NO: 4591 - RNA, 51 nt, Artificial Sequence
  Description of Artificial Sequence: Synthetic oligonucleotide
gggaggacgaugcgguucuucuggguuucccgccccagacgacucgcccga

SEQ ID NO: 4592 - RNA, 52 nt, Artificial Sequence
  Description of Artificial Sequence: Synthetic oligonucleotide
gggaggacgaugcgguugcuggucgucugcacuccccagacgacucgcccga

SEQ ID NO: 4593 - RNA, 49 nt, Artificial Sequence
  Description of Artificial Sequence: Synthetic oligonucleotide
gggaggacgaugcgguuggcuugucguuguccccagacgacucgcccga

SEQ ID NO: 4594 - RNA, 49 nt, Artificial Sequence
  Description of Artificial Sequence: Synthetic oligonucleotide
gggaggacgaugcgguugggguuucccgugccccagacgacucgcccga

SEQ ID NO: 4595 - RNA, 51 nt, Artificial Sequence
  Description of Artificial Sequence: Synthetic oligonucleotide
gggaggacgaugcgguugucucuggguugccgccccagacgacucgcccga

SEQ ID NO: 4596 - RNA, 51 nt, Artificial Sequence
  Description of Artificial Sequence: Synthetic oligonucleotide
gggaggacgaugcgguuugaucggggcgcauuugccagacgacucgcccga

SEQ ID NO: 4597 - RNA, 51 nt, Artificial Sequence
  Description of Artificial Sequence: Synthetic oligonucleotide
gggaggacgaugcgguuugggguauucccccgccccagacgacucgcccga

SEQ ID NO: 4598 - RNA, 49 nt, Artificial Sequence
  Description of Artificial Sequence: Synthetic oligonucleotide
gggaggacgaugcgguuugggguuuccgugccccagacgacucgcccga

SEQ ID NO: 4599 - RNA, 51 nt, Artificial Sequence
  Description of Artificial Sequence: Synthetic oligonucleotide
gggaggacgaugcgguuugggguuucuucccgccgcagacgacucgcccga

SEQ ID NO: 4600 - RNA, 51 nt, Artificial Sequence
  Description of Artificial Sequence: Synthetic oligonucleotide
gggaggacgaugcgguuugggguuuucccgagacccagacgacucgcccga

SEQ ID NO: 4601 - RNA, 51 nt, Artificial Sequence
  Description of Artificial Sequence: Synthetic oligonucleotide
gggaggacgaugcgguuugggguuuuccggugccccagacgacucgcccga

SEQ ID NO: 4602 - RNA, 52 nt, Artificial Sequence
  Description of Artificial Sequence: Synthetic oligonucleotide
gggaggacgaugcgguuugggguuuuuccccugccccagacgacucgcccga

SEQ ID NO: 4603 - RNA, 52 nt, Artificial Sequence
  Description of Artificial Sequence: Synthetic oligonucleotide
gggaggacgaugcgguuugggguuuuucucgugccccagacgacucgcccga

SEQ ID NO: 4604 - RNA, 53 nt, Artificial Sequence
  Description of Artificial Sequence: Synthetic oligonucleotide
gggaggacgaugcgguuugggguuuuuucccguaccccagacgacucgcccga

SEQ ID NO: 4605 - RNA, 53 nt, Artificial Sequence
  Description of Artificial Sequence: Synthetic oligonucleotide
gggaggacgaugcgguuugggguuuuuucccgugucccagacgacucgcccga

SEQ ID NO: 4606 - RNA, 52 nt, Artificial Sequence
  Description of Artificial Sequence: Synthetic oligonucleotide
gggaggacgaugcgguuuggguuuuuucccgugccccagacgacucgcccga

SEQ ID NO: 4607 - RNA, 51 nt, Artificial Sequence
  Description of Artificial Sequence: Synthetic oligonucleotide
gggaggacgaugcggacugggguuuuaucccgccccagacgacucgcccga

SEQ ID NO: 4608 - RNA, 51 nt, Artificial Sequence
  Description of Artificial Sequence: Synthetic oligonucleotide
gggaggacgaugcggauguauguugggagccacaccagacgacucgcccga

SEQ ID NO: 4609 - RNA, 51 nt, Artificial Sequence
  Description of Artificial Sequence: Synthetic oligonucleotide
gggaggacgaugcggccccuucaucuucucccccccagacgacucgcccga

SEQ ID NO: 4610 - RNA, 51 nt, Artificial Sequence
  Description of Artificial Sequence: Synthetic oligonucleotide
gggaggacgaugcggccgcagaccucacacuuguccagacgacucgcccga

SEQ ID NO: 4611 - RNA, 51 nt, Artificial Sequence
  Description of Artificial Sequence: Synthetic oligonucleotide
gggaggacgaugcggcguuguuugucuguggccgccagacgacucgcccga

SEQ ID NO: 4612 - RNA, 50 nt, Artificial Sequence
  Description of Artificial Sequence: Synthetic oligonucleotide
gggaggacgaugcgggacuguaugaggcucugugcagacgacucgcccga

SEQ ID NO: 4613 - RNA, 51 nt, Artificial Sequence
  Description of Artificial Sequence: Synthetic oligonucleotide
gggaggacgaugcggucuggguaauuccuccgccccagacgacucgcccga

SEQ ID NO: 4614 - RNA, 50 nt, Artificial Sequence
  Description of Artificial Sequence: Synthetic oligonucleotide
gggaggacgaugcggucugugugggaugcggccccagacgacucgcccga

SEQ ID NO: 4615 - RNA, 50 nt, Artificial Sequence
  Description of Artificial Sequence: Synthetic oligonucleotide
gggaggacgaugcggucugugugggauguggcaccagacgacucgcccga

SEQ ID NO: 4616 - RNA, 51 nt, Artificial Sequence
  Description of Artificial Sequence: Synthetic oligonucleotide
gggaggacgaugcggucuguugugcuugauaugcccagacgacucgcccga

SEQ ID NO: 4617 - RNA, 51 nt, Artificial Sequence
  Description of Artificial Sequence: Synthetic oligonucleotide
gggaggacgaugcggucuugggguuucuccugccccagacgacucgcccga

SEQ ID NO: 4618 - RNA, 51 nt, Artificial Sequence
  Description of Artificial Sequence: Synthetic oligonucleotide
gggaggacgaugcgguguguagcucgucauguggccagacgacucgcccga

SEQ ID NO: 4619 - RNA, 51 nt, Artificial Sequence
  Description of Artificial Sequence: Synthetic oligonucleotide
gggaggacgaugcgguucguucuggguuccugccccagacgacucgcccga

SEQ ID NO: 4620 - RNA, 51 nt, Artificial Sequence
  Description of Artificial Sequence: Synthetic oligonucleotide
gggaggacgaugcgguucugcacuuaucccgugugcagacgacucgcccga

SEQ ID NO: 4621 - RNA, 51 nt, Artificial Sequence
  Description of Artificial Sequence: Synthetic oligonucleotide
gggaggacgaugcgguuucggguuuucccgugccccagacgacucgcccga

SEQ ID NO: 4622 - RNA, 51 nt, Artificial Sequence
  Description of Artificial Sequence: Synthetic oligonucleotide
gggaggacgaugcgguuugccacauucccggugugcagacgacucgcccga

SEQ ID NO: 4623 - RNA, 50 nt, Artificial Sequence
  Description of Artificial Sequence: Synthetic oligonucleotide
gggaggacgaugcgguuuggggauuuccugcccccagacgacucgcccga

SEQ ID NO: 4624 - RNA, 52 nt, Artificial Sequence
  Description of Artificial Sequence: Synthetic oligonucleotide
gggaggacgaugcgguuugggguucuucccguaccccagacgacucgcccga

SEQ ID NO: 4625 - RNA, 51 nt, Artificial Sequence
  Description of Artificial Sequence: Synthetic oligonucleotide
gggaggacgaugcgguuugggguuucuuccccccccagacgacucgcccga

SEQ ID NO: 4626 - RNA, 50 nt, Artificial Sequence
  Description of Artificial Sequence: Synthetic oligonucleotide
gggaggacgaugcgguuugggguuucuucccgcccagacgacucgcccga

SEQ ID NO: 4627 - RNA, 51 nt, Artificial Sequence
  Description of Artificial Sequence: Synthetic oligonucleotide
gggaggacgaugcgguuugggguuucuucucgccccagacgacucgcccga

SEQ ID NO: 4628 - RNA, 51 nt, Artificial Sequence
  Description of Artificial Sequence: Synthetic oligonucleotide
gggaggacgaugcgguuugggguuuucccgugcgccagacgacucgcccga

SEQ ID NO: 4629 - RNA, 51 nt, Artificial Sequence
  Description of Artificial Sequence: Synthetic oligonucleotide
gggaggacgaugcgguuugucugggauugccgccccagacgacucgcccga

SEQ ID NO: 4630 - RNA, 51 nt, Artificial Sequence
  Description of Artificial Sequence: Synthetic oligonucleotide
gggaggacgaugcggaugguguguuacuuugccgccagacgacucgcccga

SEQ ID NO: 4631 - RNA, 51 nt, Artificial Sequence
  Description of Artificial Sequence: Synthetic oligonucleotide
gggaggacgaugcggauguauguugggagccacggcagacgacucgcccga

SEQ ID NO: 4632 - RNA, 51 nt, Artificial Sequence
  Description of Artificial Sequence: Synthetic oligonucleotide
gggaggacgaugcggucuacacauauccccgugugcagacgacucgcccga

SEQ ID NO: 4633 - RNA, 51 nt, Artificial Sequence
  Description of Artificial Sequence: Synthetic oligonucleotide
gggaggacgaugcggucuacacauuucccguugugcagacgacucgcccga

What is claimed is:

1. A nucleic acid molecule not more than 90 nucleotides in length comprising an aptamer, wherein the aptamer is aptamer-51 (SEQ ID NO:2373), aptamer-13 (SEQ ID NO:2335), aptamer-14 (SEQ ID NO:2336), aptamer-8 (SEQ ID NO:2330), aptamer-5 (SEQ ID NO:2327), aptamer-3 (SEQ ID NO:2325), aptamer-35 (SEQ ID NO:2366), aptamer-6 (SEQ ID NO:2328), or aptamer-11 (SEQ ID NO:2333).

2. The nucleic acid molecule of claim 1, wherein the aptamer is aptamer-14 (SEQ ID NO:2336), or aptamer-51 (SEQ ID NO:2373).

3. The nucleic acid molecule of claim 1, wherein the nucleotides are RNA.

4. The nucleic acid molecule of claim 3, wherein the RNA includes a modified nucleotide.

5. The nucleic acid molecule of claim 4, wherein the RNA is chemically modified (2'-fluoropyridines).

6. A conjugate comprising the nucleic acid molecule of claim 1 linked to a therapeutic or diagnostic molecule.

7. The conjugate of claim 6, wherein the therapeutic molecule is an RNAi molecule.

8. The conjugate of claim 7, wherein the RNAi molecule is an siRNA molecule or an miRNA molecule.

9. The conjugate of claim 8, wherein the siRNA specifically targets Nx1 NADPH oxidase.

10. A method for delivering a therapeutic or diagnostic molecule to a vascular smooth muscle cell, comprising contacting the cell with the conjugate of claim 6.

11. A pharmaceutical composition comprising a pharmaceutically acceptable carrier and
   (i) a nucleic acid molecule not more than 90 nucleotides in length comprising an aptamer, wherein the aptamer is aptamer-51 (SEQ ID NO:2373), aptamer-13 (SEQ ID NO:2335), aptamer-14 (SEQ ID NO:2336), aptamer-8 (SEQ ID NO:2330), aptamer-5 (SEQ ID NO:2327), aptamer-3 (SEQ ID NO:2325), aptamer-35 (SEQ ID NO:2366), aptamer-6 (SEQ ID NO:2328), or aptamer-11 (SEQ ID NO:2333); or
   (ii) conjugate comprising the a nucleic acid molecule not more than 90 nucleotides in length comprising an aptamer, wherein the aptamer is aptamer-51 (SEQ ID NO:2373), aptamer-13 (SEQ ID NO:2335), aptamer-14 (SEQ ID NO:2336), aptamer-8 (SEQ ID NO:2330), aptamer-5 (SEQ ID NO:2327), aptamer-2 (SEQ ID NO:2333), aptamer-3 (SEQ ID NO:2325), aptamer-35 (SEQ ID NO:2366), aptamer-6 (SEQ ID NO:2328), or aptamer-11 (SEQ ID NO:2333), linked to a therapeutic or diagnostic molecule.

12. An article of manufacture comprising a solid substrate coated with the molecule of claim 1.

13. The article of claim 12, wherein the solid substrate is a stent, catheter, a catheter hub, a catheter port, or a non-degradable implant.

* * * * *